United States Patent 9,216,205 (MODIFIED POLYNUCLEOTIDES ENCODING GRANULYSIN) - sequence listing, part 5

SEQ ID NO: 3888 - DNA, 5103 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggatggtattga

SEQ ID NO: 3889 - DNA, 559 bp, Homo sapiens
aaacaaagcagcatgtgcttgcggtgcggcgtcggctagggagccgagccgggaagacaccccaccgccgcagaaaggggattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcagg

SEQ ID NO: 3890 - DNA, 627 bp, Homo sapiens
ggaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctca

SEQ ID NO: 3891 - DNA, 1571 bp, Homo sapiens
aaacgggatggggagctggaccagcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggc

SEQ ID NO: 3892 - DNA, 1082 bp, Homo sapiens
agacggaattttgctctgaattccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttg

SEQ ID NO: 3893 - DNA, 541 bp, Homo sapiens
aaacgggatggggagctggaccagcagattatgagcttacagaaagcctggcctacattttactctttttggatttcttcctcatcaagagactgctgcagtgcctgtcatatggggtctcattatgtcagccaggctggtcttgaactcctggcctcaagcaattcttctgccttggcctctcaaagtgctgggattacaggcatgagccactgtgcccagcacagaaggtagttttaaacaaaagtgaaaaagaagatggacattgctgagcaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctg

SEQ ID NO: 3894 - DNA, 751 bp, Homo sapiens
gggtggttagaatttctatattttggggtccctccctccgtatggggctggagtgcaatggcgcgatctcagctcactgcagcctccgcctcccgggttcaagcgattcttctgcctcagcctcccgacagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctccca

SEQ ID NO: 3895 - DNA, 470 bp, Homo sapiens
ggaagtagggggctgggaatccgggactgtgggggcaagttgacggctcccagggtcgtcggggctgagccgagagggtgattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggt

SEQ ID NO: 3896 - DNA, 572 bp, Homo sapiens
aaaggaaccggaaacgggatggggagctggaccaggctggagtgcaatggcgcgatctcagctcactgcagcctccgcctcccgggttcaagcgattcttctgcctcagcctcccgaatggggtctcattatgtcagccaggctggtcttgaactcctggcctcaagcaattcttctgccttggcctctcaaagtgctgggattacaggcatgagccactgtgcccagcacagaaggtagttttaaacaaaagtgaaaaagaagatggacattgctgagcaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggca

SEQ ID NO: 3897 - DNA, 712 bp, Homo sapiens
ctgaattccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaa

SEQ ID NO: 3898 - DNA, 465 bp, Homo sapiens
gggggaaaggaaccggaaacgggatggggagctggaccaggctggagtgcaatggcgcgatctcagctcactgcagcctccgcctcccgggttcaagcgattcttctgcctcagcctcccgagtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttg

SEQ ID NO: 3899 - DNA, 1503 bp, Homo sapiens
gggtgggggaaaggaaccggaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcagg

SEQ ID NO: 3900 - DNA, 1006 bp, Homo sapiens
ggaccaggtgaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggctggagtgcaatggcgcgatctcagctcactgcagcctccgcctcccgggttcaagcgattcttctgcctcagcctcccgagtagcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctca

SEQ ID NO: 3901 - DNA, 926 bp, Homo sapiens
agggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggttttcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaaggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggctcctcatctgtaaaa

SEQ ID NO: 3902 - DNA, 2070 bp, Homo sapiens
cattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatcc

SEQ ID NO: 3903 - DNA, 1784 bp, Homo sapiens
cgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaatt

SEQ ID NO: 3904 - DNA, 848 bp, Homo sapiens
aaacaaacaaaaaatgagcctggcatggtggcacgtgcctgtggtcccagctacttgggaggctgaggtgggaggatcccttgagcttgggaggttgaggctgcagcaagctgtgactgcaccagtgcactccagcctgggcaacagagcgagacactgtctcaaaaaagaaaagcaaagcaaagccactcacatgaggtcttgctcctggggacgggcatggccaggactccaaccccggcagcctgtcccagagccctggagctagccccagtgcagtctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcag

SEQ ID NO: 3905 - DNA, 2062 bp, Homo sapiens
agagtattcgggaggactacaactctctagccgttcccacattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatcc

SEQ ID NO: 3906 - DNA, 890 bp, Homo sapiens
acgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtaggaggaggaggatcgcttgagcccaggaatttgaggctgcagtgagctatgatcgcactattgcactccaacctgggtgacatgagcgagaccctttctctaaaaagtaaaaaagaaagaaagactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaa

SEQ ID NO: 3907 - DNA, 1251 bp, Homo sapiens
cattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtaggaggaggaggatcgcttgagcccaggaatttgaggctgcagtgagctatgatcgcactattgcactccaacctgggtgacatgagcgagaccctttctctaaaaagtaaaaaagaaagaaacctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaa

SEQ ID NO: 3908 - DNA, 555 bp, Homo sapiens
atttctggtgccgtcacgggacagagcagtcggtgacaggacagagcagtcggtgacgggacacagtggttggtgacgggacagagcggtcggtgacagcctcaagggcttcagcaccgcgcccatggcagagccagacctctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccaga

SEQ ID NO: 3909 - DNA, 578 bp, Homo sapiens
aaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtacc

SEQ ID NO: 3910 - DNA, 1170 bp, Homo sapiens
atgagtgacgaggcagaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccaggggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctga

SEQ ID NO: 3911 - DNA, 1709 bp, Homo sapiens
gctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaa

SEQ ID NO: 3912 - DNA, 1457 bp, Homo sapiens
atcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaat

SEQ ID NO: 3913 - DNA, 1782 bp, Homo sapiens
ttttttttttttttttttttttacctccaccgccttctagtctcaccgaaggcttgtggccatctctgtaaagtttctggggaggtgggcacggggtaaacgccggagggttctgtggagcctatgggactgactggaggccaaagaactttgggccgcagatgtacaccagcgtcactcttttggtctgttagggccttcatcgctcacatcaggtttcagtgtgaaacgggaaaacatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaa

SEQ ID NO: 3914 - DNA, 674 bp, Homo sapiens
ggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatatttctcatcctgttgctcacgttggagtgcagtggtgtgatcatggcccactgcagtcttgacctcctgggctcaagtgatcctcccacctcagcctcctgagtagctgggactacagaaaggcttcccaactgatgcaactcttgatgacataaaagaatggttagaagataaaggtcaagtactaaatattcagatgagaagaacattgcataaagcattta

SEQ ID NO: 3915 - DNA, 545 bp, Homo sapiens
ggagcgctttaggctggccggcggcgctgggaggtggagtcgttgctgttgctgtttgtgagcctgtggcgcggcttctgtgggccggaaccttaaagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccct

SEQ ID NO: 3916 - DNA, 2463 bp, Homo sapiens
aacagaaatgagtgcagaagacatggagaagaacgttcagaatagctttattcataacagcaaaaaactagaaacaacaaaatggtcagaaacagaagaatgggccagacgtcgtggctcactcctgtaatcccagcactttgggaggccaaggtggatggatcccttgaggtcagaagtttgaaacaagcctggccaacatggcaaaaccctgtctctacttaaaacagtacaaaaattagccatgcatggtggcaggcacctataatcccagctacttgggatattgaggcacgagaatcacttgaacccaggggggtagaggttgcggtgagccgagattgcgccactgcactctagcctgtgcaacagagtgagcctctgtctcaaaaaaaggaaaagaaatggaagaatggataaatcagttgtggtatgtgcgtataccacatgttgtggactgtttgtagttccccaaaattcatacattgacatcctaacctccagtgggatggtattaggaagtggggcctttgggaggtaataagatcatgatggtagaattctacctcatgaatgggatttagtgccttgtaagaagagactggagagtttacttcctttctgcttttcaccatgtaaggatacatgaagaagatggccatctgcaaaccaggaagcaggtcatcatgagacaccagatctaacagcatcttgatcttggacttctcagccttcaaaactgcgagcaataaatttctgttgtttaagacacccagtctatgatattttgttatagctgtccaaactgagacccagatatatacatactacatgacctagaacaggcaaagctaatcaatggtagttacttttaaggagggtattgactgagagaggagcccaaaggaactttctggagtgctgaaatgttctatatctcaatctggatggtaattacaaggtggtgttcacttgtgaaacttcattgagcacttaaaattcatgcaccttatagtttgtgtgatataattcaattaaaaaaatgtttagcccccaaaggcccttcttttctctttatctgtcacagttattttattttacatgaagtcttggtaaagaatctgtgctgttttatcaacttccatgtactgtcttctatagaagatctacttatcattttatgcatgctgatctcgtccacttgccaaatatagcaaattgacccaagtaaatttggctgttcacaattattagataatttagaggatagtggaggtcaccaattgttagacataggggtgggctctaggtctccccttaataacctcactttcatatgacttattacaatgaaggaagtttttgtagacaagattcaccttcaaacatctattagcaagaaaacacaaaagtagtcctacaatctattcccaaaattcagggagaccctagatttctggcttttaggcaatctgatattcatcttgcgcgcgcgcgtgcgcgcgcacacacacacacacacacacacacagaaatagaaaaacttagcaagcctagcagccttcagagtggtactcttggcctggagttttgatttagttgagttttctgccccttagtgatgaattctctcaattgccctaaccaaaagtctaaaatattataatcatctgccttgaataatttttcatggatttttttccccctcgcatttaaagtccaggttagaatgataagtccattctacgaagccatcagagttggtatggaactacaggatgttgggacttggcttccttctatcttgctgctttgccacacctatggtgtttccttcatttgcttggtccagttttgctcatcatccacatctagctagttgaagaaaagagaaagtgagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaa

SEQ ID NO: 3917 - DNA, 672 bp, Homo sapiens
atggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaa

SEQ ID NO: 3918 - DNA, 7307 bp, Homo sapiens
gcgagtctccgttaagaaggtgccgcggcggcgccggagatgtgtaattaagtgaaccatatatgtttcatcatcatggagatcttggagaattatctgagcaccaggttcatatgtattcgatctcagaggcatctattggacaacaaaacactctttcagttgtgaactttatttatttattattattattttttgagacagagttttgctcttgttgcccaggttagagtgcagtggcacgatctcggctcactgcaatctccgcctcccaggttcaagcgattctcttgcctctgcctcccgagtagctgggattacaggcatctgctaccacgcctggccaattttttgtattttcagttgaaacgaggtttcaccatattggccaggctggtctcgaacttctgacctcaggtgatccaccccccgcctcgtcctccaaaagagctgggattacaagtgtgagccaccgcgcccggcccagttgtggactttaacagagggaagctttaaacatgtttaaccacaggcccaatttgaacaaagatacttcaatcattatagagaggaaaacagtactttttgttcaattgtgcaaactctccaagtatctaatggagaagtagagaagaaccctaatgaaactgagtgtgaatgaggctcagctaggcttctacttgggttcactttctcatctgtctgcctgtcctgggattgaccctcgctcctctgaagaccagcctgaaagccttaaaactggtcagatgatggatgagtctgatgaggactttaaagaactctgcgctagctttttccaaagggtgaaaaaacatggaatcaaggaagtgtcaggagaaaggaagacacaaaaggctgcctcaaacggcactcagataagaagcaaattgaaaaggaccaaacaaactgctaccaagaccaaaacccttcaaggccctgcagagaagaaacctccgtctggcagccaggcccctaggactaaaaagcaaagggtaaccaaatggcaagcaagtgaaccggcccactctgtgaatggggaggggggtgtgcttgcctctgctccagatccacctgtgctccgggaaacagcacaaaacacccagacgggtaaccagcaagaaccatcgccaaacctttccagagagaaaaccagagagaatgtgcccaacagcgactcccagcctcctccttcctgtttgacaacagcagtgccaagtccctccaaaccccgcacagcacaattggtcctacagcgaatgcagcagttcaagagagcagaccccgagcgtttgagacacgcttcagaagagtgctccctcgaggctgcgcgggaagaaaatgtcccaaaggatcctcaagaggagatgatggcggggaatgtgtatgggcttgggccccctgccccagagagcgacgctgcggtggccttgaccctgcagcaggagtttgcacgggtaggagcatcggcacatgatgatagcctggaggaaaagggtttgttcttctgccagatttgtcaaaagaacctctcagccatgaacgtgacccgaagggaacagcatgtgaacaggtgcttggatgaagctgaaaagacactaagaccttctgtgcctcagatccctgagtgcccgatttgtgggaaaccgtttcttaccttaaagagcagaaccagtcacttgaagcagtgtgctgtgaagatggaggttggcccccagctcctgcttcaggctgtgcggctgcagacagcacagcctgagggtagcagcagcccacccatgttcagcttcagtgatcacagtagaggtctgaaacggagaggacccaccagcaagaaggagccacggaagaggcggaaggtggacgaggcaccgtccgaggacctgctggtggccatggctctgtcccggtcggagatggagccgggtgcggctgtaccagcgctcaggctggaaagtgccttttctgagaggataagaccagaagcagagaataaaagtcgcaagaagaaacccccggtatcccccccattgttgttagtccaggactctgaaaccacaggccgacagatagaggaccgtgtggccctgctcctctctgaggaagtggaattgtctagcacgccaccacttcctgccagcaggattttaaaggaagggtgggaaagagcgggccagtgtcctcctccacctgaacgcaagcagagctttctgtgggagggcagcgcactgactggggcctgggccatggaggacttctacacggccaggctggtccctcctctcgtgccccagcggcctgcccagggccttatgcaggagcccgtgccgcctctggtgccacctgagcactcagagctgagcgagcgaaggtcacccgctctccacggcacccccactgcaggctgtggctccaggggcccgtcgccttcggccagccagagggagcaccaggccctgcaggacctcgtggacctggcgagggagggactgagcgccagcccgtggcccggcagtgggggcctggctggctcggaagggactgcagggttggacgtggtgcccggcggccttcctctgactgggtttgtggtgccatcgcaggacaagcacccggacaggggcggccgcaccttgctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatgggacagtgcgctctcccgccaccccagggccagcactcaggggcacggggagcagaggcccctgagcaggaggcgccagaggaggcgcttggccattccagctgctccagcccttccagggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagaaaagggacaggagcatcctcacgctgtctaaagagccagggcaccagaaaggcaaagagcgtcggtccgtgctggagtgcagaaataagggggtcctgatgttcccagaaaaatctccgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagcccaccaagaagcgaagctgtgctgcagcaggaggatgagggggcgctgccggagaatcggggctctttgggcaggagaggggctccctggctgttctgtgaccgtgagagcagccccagcgaggccagcaccacagacacctcgtggctggtgcccgccaccccgctggccagcagaagccgtgactgttcttcccagacccaaatcagcagcctcaggagcgggctggccgtgcaggcggtgactcagcacacgcccagggcctcagtaggaaacagggaagggaacgaagtcgcacagaagttttctgtcatcaggccccagacaccaccgccccagacaccgtcctcatgcctcactcccgtctctccaggaacttctgacggcagaaggcaaggccacagaagcccttcccgtccccaccccgggggccacccgcactcctctccgctggctccacatcccatctcaggggaccgcgcccacttcagcaggcggttcctgaaacactcgccgcctgggccaagcttcctgaaccagaccccagcgggtgaagtggtggaagtcggagacagtgacgatgagcaggaggtggcctcccatcaggccaacagaagccccccactggacagtgaccccccaattccaattgacgactgctgctggcacatggagcccctctcgccaattcccattgaccactggaacctggagcggaccggccccctgagcaccagcagccccagccgcaggatgaacgaggccgccgacagccgtgactgtcgctccccgggactcctggacaccacccccatccgaggaagctgcactacccagaggaaattgcaagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaa

SEQ ID NO: 3919 - DNA, 11932 bp, Homo sapiens
ccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttacataaaagattatcctatccccccgggagataaatttatactacttaatataaccccacaacaggcgcacaccacacactgcacagtgctatttatacatttttatttatttcagagtttgcctatgctacattagcgctctaatacataagatctatgctgtaaacaaaaacatcttcaaagttgaaatttgctgaaatatacttttaacaaaataacatttttaaggctccattgaaaaatactagataagatataatctcatataatcagtatgaataattttaaaaatgagaaatatttaggtcagccacacttcctttgtgccttgcaagaattcagttctgtggatgaatcagtactggttagcagactgttttctgcaaaccattttaaacatgctttagtatgcaacaaaaagggacctcaaatgctaaaatacactattttacgtggcattgaatagccttgggactggtgtagttttatcaacacttttttattaggaagaaacccaagaaaatttactgtaattgctaccacctgccactgtataaataatctaaaagggacttcccaacattgaacaacaacattgagggctgactcgagatccttctacattgtcacctcagcctggctttgcctgtcactgcttagcttgaagtagtgacactgttctgtatcaggagatttttataatggccctagcatccataattccacatgttcatcaaatggctgaagagtatgagagaagtattaaggtctatgtttgggctgtctccccacttggcatattctgtttttccctcttcaaaatagattgaaagcctcttagtgcaggaagcaggcatcagtatcaaactgatgtcatccaatgtaattattttaagctccaggtttgtctaagtttgggtgaagaatgttcaggaacatgtttgcaacatacagttatccagcttaccctttgacagattcacccttctcatcaaaatagtaagcccaacctaaaaattataagtttacaaataaaggaatagaaaaacccaaaaagctaatttacacataaaaattatcttttgctgcaataaataggtatggaaatatttgtagaattggtttaactgattttgtaaaacaaatgtcatgctattttgccatagtgagacatgcagtaattcttaaaatcacattaatagaaggcaagaacattgaatcagacttagcagataacagattcagtgataaatgaacaatagactaagcatacttaggaagctacatgagaacagaatgtattactgtgctcccgtccaaactgcatgactttattggttatagaataaatggaatttgagatgggga

SEQ ID NO: 3920 - DNA, 10444 bp, Homo sapiens
gccgggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 3921 - DNA, 10531 bp, Homo sapiens
gggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 3922 - DNA, 6247 bp, Homo sapiens
acttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 3923 - DNA, 1530 bp, Homo sapiens
ccctgtgacctcccaacttcacaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaaca

SEQ ID NO: 3924 - DNA, 1518 bp, Homo sapiens
acttggagtctcgcggccgccgcctccgccccgcgttcggggccttcccgaccctgcactgctgccgtccgcccgcccggccgctcttctcttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggta

SEQ ID NO: 3925 - DNA, 1147 bp, Homo sapiens
agtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttg

SEQ ID NO: 3926 - DNA, 1567 bp, Homo sapiens
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttg

SEQ ID NO: 3927 - DNA, 3087 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttga

SEQ ID NO: 3928 - DNA, 2292 bp, Homo sapiens
agtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttga

SEQ ID NO: 3929 - DNA, 1152 bp, Homo sapiens
agtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgca

SEQ ID NO: 3930 - DNA, 647 bp, Homo sapiens
accaaacccaagggaccacacagcccattctgctccgtataccagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcataatcgctcctttgcacctctaaaaagatgtcccttaccctcattctggagggctcctgagcctctgcgtaaggctgaacgtctcactgactgagctagtcttcttgttgctcgggtgcatttgaggatggatttggggaaggatcaagtgaaccatccctagtcttccttcaataaataacttttaactcc

SEQ ID NO: 3931 - DNA, 270 bp, Homo sapiens
atgaattctcagcagcagaagcagccttgcaccccaccccctcagcctcagcagcagcaggtgaaacaaccttgccagcctccaccccaggaaccatgcatccccaaaaccaaggagccctgccaccccaaggtgcctgagccctgccaccccaaagtgcctgagccctgccagcccaaggttccagagccctgccagcccaaggtgcctgagccctgcccttcaacggtcactccagcaccagcccagcagaagaccaagcagaagtaa

SEQ ID NO: 3932 - DNA, 5968 bp, Homo sapiens
cctggctgcgcgcggcggtggcggagccgctacggctgtagcagcagccgcgaagatggcggaagggctggagcgtgtgcggatctccgcgtcggagctgcgcgggatcctggctactctggccccgcaggccgggagcagagaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggctgagatagaaaagagcccaggtggtgggagagtaggggctgcaaaaggagaaaaaggaaagaggatgggaaaaggggagggggtgagggaaacccacgacgacccagcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttctgagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctctctcctcactggcctttctttccgtctagcttcctcttcaggaaatgtcctgactcccctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacatacctg

SEQ ID NO: 3933 - DNA, 2646 bp, Homo sapiens
atgagatttaggctttgccaccagaggggttgctgtccacatgagagagagaacacctgcacctgtaaaatgatcatcagtagtctccaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttctgagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctctctcctcactggcctttctttccgtctagcttcctcttcaggaaatgtcctgactcccctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacatacctg

SEQ ID NO: 3934 - DNA, 1675 bp, Homo sapiens
ctgaaaactcctttatcttgaatttgttcaaaattgcaggataccgggaaggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcc

SEQ ID NO: 3935 - DNA, 6331 bp, Homo sapiens
agcagtaggcgctggggccgcggcggaccctcgctgccctacctctctcgcgggttagtgcggggtcgggctcggccagtcctggccagctccgggagagcctggcccgaattcctgcctccaccctctttctcgccgcgaaggtgactgttccttttgccccagccctctcagacccgccccggattcccaggcatcgggagacgcggaaaggagtggggtctggtggaggccccgggcgtatcgctctccaggccgccctccgcgggcctgccccggccaccgctttaacgtcggagagaaggaattggggagaaaggtttaagagcctgcgacttcgttgctgaacttttcccccccaagacaggcttccgaaagctgcgccactggagggatccgggacctcagactactcgggtttggccctggcatgtgtgggagcagtttttattagagagaatgctcaatttgcaagttaatttcaagtctccagccacgtcaggaaaaaaacatgaaggaattaaaggaggccaggccgcgcaaagataacaggcgtccagatctggaaatctataagcctggcctttctcggctaaggaacaagcccaaaatcaaggaaccccctgggagtgaggaattcaaagatgaaattgttaatgaccgagattgctctgctgttgaaaatggtacacagcccgttaaagatgtctgcaaggaactgaacaaccaagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggctgagatagaaaagagcccaggtggtgggagagtaggggctgcaaaaggagaaaaaggaaagaggatgggaaaaggggagggggtgagggaaacccacgacgacccagcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactcagacgccccagctacatttcttggacactgatgatgaagtcagccctacatcttggggtgactcacgccaggctcaggcatcttactataagtttcaaaactctgacaacccctattattacccccggacaccaggccctgcctcccagtatccctatacgggctataaccctctacagtacccagtgggccctacgaatggtgtgtacccagggccttactacccaggctacccgactccgtcaggacagtatgtgtgtagccctctacctaccagcaccatgagtcccgaggaggtagagcagcacatgaggaacctgcagcaacaggagctgcacaggcttctccgggtggctgacaaccaggaactgcagctcagcaacctgctctccagggaccgcatcagtccggagggcctggagaagatggcgcaactcagagctgaactgctgcagctatatgagcgctgtattctattagatattgagttctctgataatcagaatgtggatcagatcctgtggaagaatgctttctatcaggtgattgagaagttcaggcaacttgtcaaggatccgaatgttgagaacccagaacagattcggaacagacttttggagctcttggatgagggtagtgacttctttgatagtttgcttcagaagctgcaggttacttacaagttcaaactggaagactacatggatggtcttgccattcgcagcaagccattacgcaagacagtaaaatatgccttgatcagtgcccagcgatgcatgatatgccaaggagatattgctaggtaccgggagcaagccagtgatacagcgaattatgggaaagcacgcagttggtacctgaaggcccagcacattgctcccaagaatgggcgcccctataaccagttggctttgctggcagtgtatacgaggaggaagcttgacgctgtctattactatatgcgcagtttagctgccagcaaccctatcctgactgccaaggagagtctcatgagcttgtttgaagagaccaagcggaaggcagaacagatggaaaagaagcaacatgaggaatttgacctgagccctgaccagtggcggaaaggaaagaagtctactttccggcatgttggagatgacaccactcgcctggagatctggattcatccatcccatccacggtcttcccagggcactgagtctgggaaggattctgagcaagagaatgggctgggcagcctgagtcccagtgatctgaacaaaaggttcatcctcagttttctccatgcccatgggaagctgtttacccggattgggatggagacattccctgcagtggctgagaaggtcctcaaggagttccaggtgttactgcagcacagcccctctcccattggaagtacccgcatgctgcagcttatgaccatcaatatgtttgcagtacacaactcccagctgaaagactgcttctcggaggagtgccgctctgtgatccaggaacaagccgcagctctgggcttggccatgttttctctactggtccgccgctgcacctgcttacttaaggagtccgccaaagctcagctgtcctctcctgaggaccaggatgaccaagacgacatcaaggtgtcttcctttgtcccggacctgaaggagctgctccccagtgtcaaagtctggtcagattggatgctcggctacccggacacctggaatcctcctcccacatccctggatctgccctcgcatgttgctgtggatgtatggtcgacgctggctgatttctgtaacatactgactgcagtgaatcagtctgaggtgccactgtacaaggacccggatgatgacctcacccttcttatcctggaagaggatcggcttctctcgggctttgtccccttgctggctgcccctcaggacccctgctacgtggagaaaacctcggataaggttattgcagctgactgcaaaagggtcacagtgctgaagtattttctggaagccctttgtggacaagaagagcctctgctggcattcaagggtggaaagtatgtgtcagtggcacccgtcccagacaccatgggaaaggaaatgggaagccaagagggaacacgactggaagatgaggaggaggatgtggtgattgaagactttgaggaagattcagaggctgaaggcagcggaggcgaggatgacatcagggagcttcgggccaagaagctggctctggccaggaagatagctgagcagcagcgtcgccaggaaaagatccaggctgtcctggaggaccacagtcagatgaggcagatggagctcgaaatcagacctttgttcctcgtaccagacaccaacggcttcattgaccacctggccagtctggcgcggctgctggagagcaggaagtacatcctggtggtgcccctcatcgtgatcaatgagctggacggcctggccaaggggcaggagacagaccaccgggctgggggctacgcccgtgtggtacaagagaaggcccgcaagtccatcgagttcctcgagcagcgattcgagagtcgggactcttgcctgcgagccctgaccagccgtggcaatgaactcgaatccatcgccttccgcagtgaggacatcactggccagctgggtaacaacgatgatctcatcctgtcctgctgcctccactactgcaaagacaaggctaaggacttcatgcccgccagcaaagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttctgagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctctctcctcactggcctttctttccgtctagcttcctcttcaggaaatgtcctgactcccctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacatacctg

SEQ ID NO: 3936 - DNA, 3738 bp, Homo sapiens
gggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtgggatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttcttctgttccatttcagttcagtttcagcggtgccaacctctttgcgtttcctttttgttgatgaggacccagagctgctgcacacactcacctctaaccccctcccctcgctgctgggccccatctccacaggagagactggttcagctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataaa

SEQ ID NO: 3937 - DNA, 831 bp, Homo sapiens
gcagccgcggtgttgtgctgtggggaagggagaaggatttgtaaaccccggagcgaggttctgcttacccgaggccgctgctgtgcggagacccccgggtgaagccaccgtcatcatgtctgaccaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagagga

SEQ ID NO: 3938 - DNA, 1071 bp, Homo sapiens
gcggaagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgcc

SEQ ID NO: 3939 - DNA, 1536 bp, Homo sapiens
ctgcgcgaagcggaagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaatt

SEQ ID NO: 3940 - DNA, 534 bp, Homo sapiens
ccaccgtcatcatgtctgaccaggaggcaaaaccttcaactgaggacttgggggataagaaggaaggtgaatatattaaactcaaagtcattggacagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctccttttt

SEQ ID NO: 3941 - DNA, 779 bp, Homo sapiens
gaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggctctgtggattagactcacctctgcttcttggtgtgtggggcctcagctgagatgactcaagtggctgggggctggaacagctagttgtcaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagag

SEQ ID NO: 3942 - DNA, 1686 bp, Homo sapiens
tagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaa

SEQ ID NO: 3943 - DNA, 2088 bp, Homo sapiens
agttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgtt

SEQ ID NO: 3944 - DNA, 2204 bp, Homo sapiens
tctggaagccaggcgggcagggcagagaccccggctcctgcgcccctcctagctcccagagagcgtggatcgcgggcggggctcaccgagcgagctgtcccagagggaggagctgaaatctgaacctctcagctgtgattggatctttcttgcaaaagagaggaaaaaaaaaccctcccagccaaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaa

SEQ ID NO: 3945 - DNA, 1713 bp, Homo sapiens
cagcagtccggacccaggcgcgcccctcccgccccagcccaccccggcctgccgcccgggaggggaacatgccgcgctccttcctggtgaaaacgcactccagccacagggtccccaactaccggcggctggagacgcagagagaaatcaatggtgcctgctctgcctgtggggggctggtggtgcccctcctcccccgagacaaggaggccccttctgtgcccggtgaccttccccagccctgggaccgctcctcggccgtcgcctgcatctccctgcccctcctgccacggatcgaggaagctctgggggcctctgggctggacgccttggaagtcagcgaggtcgaccctcgggccagccgggccgccattgtacccctcaaagacagcctgaaccacctcaacctgcccccactgctggtgctgcccacacggtggtccccgaccttgggcccagaccggcacggggctccggaaaaactgcttggggctgagcggatgccccgagccccgggcggctttgagtgcttccactgccacaaaccctaccacacgctggccgggctggccaggcaccggcagctgcactgccacctgcaggtggggcgtgtcttcacctgcaagtactgcgacaaggagtacaccagcctgggtgccctcaagatgcacatccgcactcacacgctgccctgcacctgcaagatctgtggcaaggccttctccaggccctggttactgcagggccatgtccgcacccacacaggggagaagccctatgcctgctcgcactgcagcagggcctttgccgaccgctccaaccttcgggcccatctgcaaacgcactcagacgccaagaagtaccggtgccggcgctgcaccaagaccttctcccgcatgtccctcctggcgcggcatgaggagtctggctgctgcccgggcccctgagaggcacgtggtcggcgcaggtaggagggatggtcctcaccgggagagctggcgtccctcctgcccccagaggagccaggagtctgggagggcggggcctggcctcacacttggtgcgtcctccacatctgcgtccaatcagaaccaaagaagtccagcgggggccactgggccggaggacactcccccaggcatcccaccgcgcggagcccactcagaggagactcctctcccggggaaggctttcatcagaacaagagccatggttccatttcgacacggccaggtctccggggctacccttccaagagtcagagcctcggggaggtggccgccagcatgggccggcactgccgccggatggctggcaaggctgcctagttccattgcagcagaaatgaacagttctgacttatagtgagcaccgccctgtggcccttcctcagtaggcacaactacctctcagccagcccccgccagcctttggtttggggtctgggacgagctgccccatgtcacacgtctatgtgcatgtgcacacacactcaaacatgtacacacacgtgccctccccacctcactagactctccgggagatggggcaggactgggagagcccacgattggtgatttgggtgtgttgggatgaggcggagtgcctgtgggatttgtcccggtcagagcctcagggggctggggtctcagggcactcagcttcccaggcaataacagccgtggggtaataaatggtctctgcacacctgca

SEQ ID NO: 3946 - DNA, 4830 bp, Homo sapiens
tccttggccttgcatggcctgtttatttttaaaagtgcaaacttgcaaccccaaacaagctggggccctgaggccgtcaacccctccagtctcccctgtgacccgcagtctgcgtcctgttcccagtttcattcctcaagtgcatatatttttatttttttattttttttttgagacagagtctcgctctgtggcccaggttggagcgcagtcgcgcgatctcggctcactgcaagctctgcctcctgggttcacgccattctcctgcctcagcctcccgagtagctgggactacaggcgcctgccactgcgcccagctaattttttttatttttagtagagacggggtttcaccgtgttagccaggatggtctcgatctcctgacctcgtgatccgcccgccttggccccccaaagtgctgggattacaggcgtgagccaccgcgcccggcctcagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctgaggcgtgcgacactctgtcctgtcccaggcactgtggtgggggcatccggtgtccaggtgcagaggcaaaagctgctcccgggtttcccagaaatggttccgaggcctgggtcccagagagccagtgcaggttggggggtggacctctggctctgtgggggggtctgttctgctccagtgggccgtgtctgccttgtcatcatccagacagccacagctggctcctgggtcccctcgtcaagcagcatttcccagtaacagtgacttcgtggaacacttaggaagcccttaaaaaccatcctcggacctctgaggcagggactccagggggcacagcacctgtggtggggacaggcaggcaggctggatgcggggagggcccgggaggaggagtgaggagccacgcacggaactgctcagactctcccagcaaaggtcctggcccttgtgcatgcctttagttacatgtctgccttagaggcaaagacgagccgtcacgggggacccaccgggtcaggggtctgcggacacgcttgcaggaggaacccaaggaaagggggtgggggtggagccccacagattgcgtcgtgggtgggcgtggagcttgcacagcaggcctgctgctgcctcccagggcgctggttcacagcacggtcccagcagggagaggctgagccggttggactagaccacccaaggtctcaggttgcagctccctggtgaggagaggacaaggtgacttctgggtggggtggggcatgaagatggaagtctgacctcgggttccaacttgactcaaacgagctgagctcctggagtttagaaagggacaccagcttcagacatcgtgggggctggcatggtttgctctcgtgggctggatgggagcctccctagcccctcctgatttcaggctgcagcctatgggtcactccaggcacaggtggggtgagtcaagatctcactggaggagtcactgagcaagagggccggtgggaggcaagggggcatccagggacaaggggccagctctgcccccacttccccaccccacccactctaatactgcagcccctgtgcttccaactgccccctccagcctggggcccagcccctcaccgccagagactgcccgcctcctcttgggcaagctcctggtgggctccactgaagccaaagtgggcccttgggggcaggagagccagagcaaggcacgctccacctagatttagaccgggagagacctggaggatgccaaccccagaggtcctggggcgagctcagtgctggggaccggaggtgccgtctgctgccagaatcatggtgtgcgtggtccctgcccagcacgggtcagccagagcgagccagggcagaaatgacggccaggtcgatgttcctgtcgggggctgcttgtcccaggaggtaatctgagtcctggccgagcccaaaaaagccactgccctttagagccagctgtgagggtgcaggaggcagtgcagagggagtgggacccacagctgctagcctccctccaaaccctcctgcctccaccagacaccaggtcagggggccacaagtgtgggtgccgggcagctgcccctcagctgagctgccgggccacccagctcgtgtccctcccctgccaggctgcagctgggatggtcacccgggcagcctgagtcagcctgctttctctctcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctggtctttgcaccctgtcctccatccagcccggcccagcgcttgggcttgtcctggacacctaacacccacctgccctcgtggccagcagtggcctgcgtggctgggagcccggtcagaggccgccggggccctcagtaggtgcgtcgtgggcgctggggacggcagcgggtgccctggcgggccgcgtgcagccggagagatgccatgtccctgctcctctgcaatgaaaagcaagcgaaaag

SEQ ID NO: 3947 - DNA, 2002 bp, Homo sapiens
ggagcggaccggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttagga

SEQ ID NO: 3948 - DNA, 2033 bp, Homo sapiens
ggccactgcacggacccagggaacgggctgacagtccagcagaggcctcagcgaggcggcggcgctgcgcacaaacctgaggacctaggcgggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttccta

SEQ ID NO: 3949 - DNA, 2054 bp, Homo sapiens
cggaagttcagggagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtttccta

SEQ ID NO: 3950 - DNA, 1884 bp, Homo sapiens
agccgcgcgcccgccgcgccgccttgtgggcgctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 3951 - DNA, 3811 bp, Homo sapiens
agccgcgcgcccgccgcgccgccttgtgggcgctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactc

SEQ ID NO: 3952 - DNA, 1724 bp, Homo sapiens
gtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggccttaaggatgtcccggcccagactcggcctctgcctgcctggtcccttcccaccccagagtgcagccccagcaagagcaggtatggcggcctcctctgcagaggaccctggcagcgagaggggaccctggcggcgagcggggaccgtggcggcgagaggggaccctggcggcgagaggggaccgtggcggcgagaggggaccctggcggcgagaggggaccctggcggcgagaggggaccgtggtggcgagagggaaccctggcggcaaaaccgagaatgcagtgggtcactcgggccacggctccctga

SEQ ID NO: 3953 - DNA, 3572 bp, Homo sapiens
agctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggccttaaggatgtcccggcccagactcggcctctgcctgcctggtcccttcccaccccagagtgcagccccagcaagagcaggtatggcggcctcctctgcagaggaccctggcagcgagaggggaccctggcggcgagcggggaccgtggcggcgagaggggaccctggcggcgagaggggaccgtggcggcgagaggggaccctggcggcgagaggggaccctggcggcgagaggggaccgtggtggcgagagggaaccctggcggcaaaaccgagaatgcagtgggtcactcgggccacggctccctgaggacaggaactggccccggccccacctcatcccacgctggagtcgtgcacagacgtccctcgggaggagtgaagaggccaccgggtctgcgtctcaggtaaaaaggtgactgaaaatgccccaccctgctgacatcagggagacaaagctcttggctcaaaagacagcagagtggacacctttgggctgagcgggagaacccccagcatggagggcttggagggcatggagggcatggagggcatagagggcatggagggcatggcccaggcccatggatgccctgctgagaatccacaggggcctgttgtatgtgtgtatatgggtgcacatgtgtgcatatatgtgtattggtgtgtatgcatgtgtatatgtatgtgtgcatgagtatacatgtgcagtgtgtatgcccatcatggaatgggccagggagggctcatagtcatgtatgtggatacacatgtggatacgtgcacatgtatgagtgtatgtatatacctgtatgggtgtgcacgtggacaggctcgtatatgcatgaatacatgtgtatatgtgcacctatgtggagtgtatgggcatgtgtacacacatgagcacgtgtggatgtgtgtgtgcgtgtatgtgtgcgcgtgtgtatgggcatgtatgtgcatagatgcatgtgtatatgtgcacacatgtatgagtacggccatatatgtgcatgcatgtttgggcacacgtgtgcgtgtgtggacatgtatgactgtgcatgggtatggcatgaccagtgctgtgtggccacatggcagggctgcttataagtggcctctgggaggagctgcaggaccccaggctgtggccaggccattcccaggtcctggtctcccagccacccagtccgccccttgagagacactcaccctcatgccaaatccaaggctggcatctcccggctcccctttctctcctttcaatccgttcatcccggggcgaccctggggcggagcacagggggtggggactgctgggcactgatgattaccagacaccttcccgcagggtgcctgccgttagccccacgccaggcccggccggcccacgctcagcctcacacgttcccagctctcaggctaccccggcccttctcacccctttcctgcacaaggacccttttgggaggaggtgactgagcctagcacacacaggcccactgccctgtctgcctccagggcttcctcctgggtactggcccctcgtggggtactgccagccacatccaggacaagagctgcgctcaggcagggccggttcttgggggaggacagtgggtgcggcggccgtccactcccctctgggcatgtcacccccgtgggcctgggctgctccccacctgccagaccccatctgccgcccccactggagaccccaggtcctcaccggccgtccaggaaagccaatctctcccttgtaccccggccgtccgtatggaccctgcaagaggaagggggccaggcttagtggggcagaccctggcccttgaccacgagttggggggtcctggggaaggggaggggccatgcagagcacagcaccctgggccacccatcagctcggaggagcccactgcagcctcacgccgacacctgccccacacgctttaaaactgcactagggagatgagccctgggccgcacagcacaagctcagcagccgcgggcgaccgtgtccttgggggccgtcatgcccgagctcagtgcagagaaagccagggaccgacttaccgggggtcctcggaagcccggctctccctgagcaaaaaaacaagaagacagggttaggtggcagcttgtgccccacctggcagcctctctgagggcccctgtggcgaaggcacggttaggtggcggcttgtgccccacctgatagcctccctaagggccgctgtggtccctttgggtgcactgggccgtccccaaggcgcaggcagccctggggaggacaggagccactggtgaggggagggtcgggtttggggtttgcgtccaggttggtgcgtgcatgcatgccccgggaccctgaagcaggggtggagggtggagggtggagggcatgtgccacgcagtgtcctggttgccacaggccccagctccaatgcacagctgggtgggatagtggagctctcactgggcctggggatcctgtgtctgaggcccaccccaaacaccccggagggctcactgctccctctgaaagtgggagagccggtggcccacactccaaagatccaggcttctccccaggaccctccccgagggcttttctgggcggctgcctgctgggggtggggacgcaggcacaggccccttgaggaactgactccgggccctgcccacagcatcagggcccccaggaagaggctggaggggcagccagaaacctgctgaggctgagctggtacagcctgggctcctgcaccccacaggccaggccccagggaggcgcgagctcagagctgcagcccactgagaacctcccctcagcagggtgggctcaggggtagggagaggacgaggggcagggagaggacgaggggccggcggaaccgccgacatgggtgcgagaaaggaggggccaccagggccaggcctggatggtagagccctgcttgggagaggctcgtgcatcaggagccagaccctcaggaagaccctccccaggctgtctccacagccccaggagcccccacgcctgccggaaggaggctgcccggccctcaccttg

SEQ ID NO: 3954 - DNA, 648 bp, Homo sapiens
gtggatccggcgttcgcgcccaggcacgtgttgcttcgggacgggccagccggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttct

SEQ ID NO: 3955 - DNA, 777 bp, Homo sapiens
tcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggcta

SEQ ID NO: 3956 - DNA, 1805 bp, Homo sapiens
aggtgcctgatgaggccccagcctgcagagccagctcctggtggaagaggaaatgaggcatgctccattcattcggaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtg

SEQ ID NO: 3957 - DNA, 580 bp, Homo sapiens
agtcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacagcagggccaggttctgcccacccgtggagaaggccagtacaggggagagagccagggctcccacaaagcagggggtccctccaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcg

SEQ ID NO: 3958 - DNA, 1031 bp, Homo sapiens
gaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttgactcttctcagtccctttcttctcactctaggcttccaaccacagggcccgccttcccccaacatgccgcaggctgttatgcacagtaccctctctccaggaggcttccccttccctgt

SEQ ID NO: 3959 - DNA, 1700 bp, Homo sapiens
aagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcaccctgaatggttccatgcctgagggtggagactaagccctgtcgagacacttgccttcttcacccagctaatctgtagggctggacctatgtcctaaggacacactaatcgaactatgaactacaaagcttctatcccagg

SEQ ID NO: 3960 - DNA, 1833 bp, Homo sapiens
aagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgcccatgtatgtgggtgaagtgtcacccacagcccttcgtggggccctgggcaccctgcaccagctgggcatcgtcgtcggcatcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatg

SEQ ID NO: 3961 - DNA, 705 bp, Homo sapiens
agtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaatcccaaacttgaaacaacagatacgcctctgccgaagaagtttccctttagaccccaagcccgtaaggtcactgcagtgcagtgtcccttctgcctgagtatttgtccccttcattctttactcatcctgggtcccacatccactgctacagaggcagggaagggccacaatgtcca

SEQ ID NO: 3962 - DNA, 2851 bp, Homo sapiens
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaag

SEQ ID NO: 3963 - DNA, 913 bp, Homo sapiens
tccctctcagtggccatcttttctgttgggggcatgattggctccttctctgtgggccttttcgttaaccgctttggccgggtattacctctgacccagcccctcggagcccaaggaatgtgggcactggcctgacctgtgaccccgtccccaggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcggtgagtctttgcttactggcccccccagccaaaccccagggaggaggcagtgccatcttccc

SEQ ID NO: 3964 - DNA, 3348 bp, Homo sapiens
gcggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgctcggctccccttgtgccgtgccgcggcggctggcgctacgcccaggcccactccaccatcgtcagcgagtttgaccttgtctgtgtcaatgcgtggatgctggacctcacccaagccatcctgaacctcggcttcctgactggagcattcaccttaggctatgcagcagacaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattgtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactgggtggtccctgagtctccccgttggctgattactcggaagaaaggagataaagcattacagatcctgagacgcattgctaagtgcaatgggaaatacctctcatcaaattactcagagatcactgttacagatgaggaagttagtaatccatcctttttagatctggtgagaactccccaaatgaggaaatgcacacttattcttatgtttgcttggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaaggaatagcatggttgaggaccacagtggctacattgggaagactagggataaccatggcctttgaaattgtttatttggtaaattcagaattgtacccaacaacattacgaaatttcggagtttcgctctgttcaggtctgtgtgattttgggggaatcatagccccatttctgctctttcggctagcagccgtgtggctagaactacctctgatcatctttggtatcctggcatccatctgtggtggccttgtgatgcttttgcctgaaaccaagggtattgccttgccagagacagtggatgatgtagaaaaacttggcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgta

SEQ ID NO: 3965 - DNA, 5627 bp, Homo sapiens
ctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgctcggctccccttgtgccgtgccgcggcggctggcgctacgcccaggcccactccaccatcgtcagcgagtttgaccttgtctgtgtcaatgcgtggatgctggacctcacccaagccatcctgaacctcggcttcctgactggagcattcaccttaggctatgcagcagacaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattgtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactgggtggtccctgagtctccccgttggctgattactcggaagaaaggagataaagcattacagatcctgagacgcattgctaagtgcaatgggaaatacctctcatcaaattactcagagatcactgttacagatgaggaagttagtaatccatcctttttagatctggtgagaactccccaaatgaggaaatgcacacttattcttatgtttgcttggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaagcaggaatagcatggttgaggaccacagtggctacattgggaagactagggataaccatggcctttgaaattgtttatttggtaaattcagaattgtacccaacaacattacgaaatttcggagtttcgctctgttcaggtctgtgtgattttgggggaatcatagccccatttctgctctttcggctagcagccgtgtggctagaactacctctgatcatctttggtatcctggcatccatctgtggtggccttgtgatgcttttgcctgaaaccaagggtattgccttgccagagacagtggatgatgtagaaaaacttggcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgtacatttgccctttctcttccttctaaacatgtgtctctcccacaggtcattctcctgtgacacgtgtactgcagagtgtttcaaaaccgggcaggcaattagcaatgggaaataagtggtccaccttcaatatttgcttgttgttcatttacatgctcttggcaccaatcctagactcacgtgtgccccagaataacattcagactctcagctggtcttgtgttacacatccatggaccggttcactccatcatatacagctctctgctccgtgtcccctgggctcaagtcaagcagtcggtgacagatttcattcccaataacagaatcggtttgcatgactccccatacatgttgcagctttgaaaacattcatctcagagttaggtataaagacataaaaatgtgtgtcaagccctcgttagctgatgaggtaaatgcatggacaacttcctaggacttctcggctctgccctctgtgaccttgcagcctgctcaggtctttgtgctctgttccttatcaaaaacagcacaaccccctcaatctgcccatttaaaaattggtggagtgaacaaagagcatgaaaatgttgaagaccacaaccaaaatttactcaaatcaaagttaagtacagagtttatttttaacaaatgtcatagctatgtcaccttactacagaatccagcagtcagaaaataacacaaaaaatgccgaggtttggcgtagctggtagctggggacagtgtcttcgtttgattactgccagttatttccagcatgctaaatccctacccacgttccagcctctaggtgagtcagtgcgtcactctgtctcccgtccaattaattatttctcatcactccctcaatccaagtaacaaaccttgaaacacgaacatagacaccaggcttattggggcgtgcacagccaagaccccaagaagtgactccttgtaaaatgtatttgtccttctcaaagcaaaccagaggccctccactgtcaccctaaatagaggtagggaaaaattcatgtgagggttaggctgccagccttttattgtggcatccatctattgtccatatgtatattttcccagtaattgaaattggaaaggaacttatgggcatattactggagcatctgcagtgcttaagtacttagcaaaatctattcagcgaaaccacaccacttagtttctcccaggggtaaaaaaaacccttgtgaatcctgcacacatcccttcctgtgttggtgtttcctttagactggcctagcctgggcatcactgtaaagtatgtgcagttggtctctgtcctgtaccctctacctccttccctgtcggaaaagtcaccactttagtccctggccaccagcacaccccaggagggtgagtggcctgaggtagttacggcacttaaaactcccttgctaccgatctggaactcaagccccaagacatccccttagatgatctgaatacgcattcagggacagatctaggcagtttctaaacaacacttagactggggtctaacgttgacaaatccttctagaatttgcctctttgggactgaagtctaaggggctgagaccaagaagggagagcacaagactaactttggtctcttgaccttttcttaccttgcaactgtcagtgcctccagccaaatgcctagcacagagctcagtggatttgattcttccattcagatactcatagcgattgcacactttattctcaatcacaagaagctggggcttccttgagaaggccagccccaaaggtacctgtgtttaaaagatgaaagaaatggttgctgaacccaaaacatgtttaggaggaaaaccagaagaacagagcagtggcactggacctcctgtctgtccgtgaggctgcagaacacaaggcagctcccaatgccgctggactctctgaccttggagagtgtaaacatcatatatgattctgtgttcctgagatctgggtttaacgatctgggctttgtcatggtgttttacgttcgttgttgtttgtgtactttttgcttttcttttgaaagtatgaaaatgatttttacaatgtaaagagagtctgagaaatgcaattgctattctttttatatactttttcagattttttatatgcttctttactacttacatcataatgcacaattttatatactgattttttcaatcaatgtatatcatgagtttttaaaataatgctacaatcttcataactaatattttaatggggagtgactgcttaattggcatgaggtttccttttgagatgaggaaaatgttctgaaaatatggtgatggttgcacaccattgtgaatgtactgaatgccattcagtggtaccctgcaaaataattaaaatcctaactctta

SEQ ID NO: 3966 - DNA, 4823 bp, Homo sapiens
acaccaatggcgcggcggccgccggcctcttggttcccggcgattggtgtctctggccgctgcgctccaccccagcccgccatggcgtcaggcgccgcggccccggggaggtggctcccactttaagaagtgaagttttgcgcccctccccctccctgcccacctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcattttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgcatccttgtctgctctgcgtcacccgagaacacaggcttcgcagcctcgctttctgaaatggtgtgtgccgagtcagattgccgctcagagaaaatacaagcccgttttccctagctgtgccatttggtgctctgccaggctgccgtgcaagggaataccgacgagacgagctgcactgtctctgatttggagccctcaccggagcttgtctttaaaaatgagcaggaagctcatgtatgtttgcatttcagtgagccgggtcctgacctgccgccacccatcacggtcagcgtggtgcatcttaccgaggaggcgcaggcctggattcttttgagtggtgctactgcctaggaagtaacacgtggagaatttccatcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccactccccaaaaccagttgcagcctcaacccacatggggatgtagaaagccgtaaagtccacgctactgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggattttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgatgaaaccccatctctactaaaaatacaaaaaattagctgggcatggtggcaggcacctgtaatcccagttacttgggaggctgaggcaggagaattgcttgaacccaggaggtggaggttgcagtgagctgagattgtgccactgcacttcagcctgggcgacagagtgactctgtcaaaaaggaaaggcaaaaaccggaccctggagctctgtgggccctgattgcaggcccctccctgtgtgatgagggatgagtcagcttggggagccacttggccagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaacctttgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgaacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcgaa

SEQ ID NO: 3967 - DNA, 3619 bp, Homo sapiens
agtcctgggcgaagggggcggtggttccccgcggcgctgcgcgcggcggtaattagtgattgtcttccagcttcgcgaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagagcacgagcatcactctgaccatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttg

SEQ ID NO: 3968 - DNA, 1666 bp, Homo sapiens
agtcctgggcgaagggggcggtggttccccgcggcgctgcgcgcggcggtaattagtgattgtcttccagcttcgcgaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaagaagtcttattacattattgaccaacaataaaatagagaaaatattc

SEQ ID NO: 3969 - DNA, 1774 bp, Homo sapiens
aattagtgattgtcttccagcttcgcgaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttca

SEQ ID NO: 3970 - DNA, 4178 bp, Homo sapiens
attaacctatcaaataaggcagtctaaaaactccaggcgtccctttccgtaaggacccggactgttgaactggaaagctaaaattcaaggcgtgacaattgccctttgtcccacattcctccaccggtcgcctgcttatttaaatggtgcgtcccctcgggtaccacttgaacaaaacctgcccagagcgctccctgtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaagttgggatcatggtggctggatttgcatccgtgattatacaggctgtggtgatgcaaggtggaatcagcactattttaaatgatgcctatgatggtggaagattaaatttctggaattttaatcctaaccctttgcaaagacacaccttctggacaattattataggagggaccttcacatggaccagcatctacggtgtcaaccaatcccaggtgcagagatatatttcttgtaaaagcagattccaggcaaaactgtctctctacatcaatcttgtgggactctgggcaatcctcacatgctcagtgttttgtgggctcgccctatattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgatgacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggaggaagaaaacagaacttagaccccagatacatactaaccaaagaggactttttatccaattttgatatttttaagaaaaagaagcatgttttgagctataaatcacatccagtggaagatggtggaactgataatcctgctttcaaccacattgaattgaactcagatcagagtggcaagagcaatgggactcgtttgtgaagctgctctgatactagatatccttaaatgatgtttcaattttatatgttttctaagataattggatcaggttttctttgtgtgtgtgtgtgtgttgtatcatgagtgtttgggggataagtttttgttaaaacaaagtctggactatcttcatttactacatcattaattgatgttactctggagtttagaattctggcattgacatttccctctctttcctttatttcgatgaagctataattgtgaaaattgtaactacatagatgctgaaaggctaatacacacatatgcacatgtatttgattgtcaaaggtatattcttaaatttgggtattattgaaaatattttccatgccttggtgctagcatataagtttggaagtttgccaacatcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttattttctgatacgtgttatttaggtaatcatgccctgtacatttagaggttgctaactgacaatgttaagaaatttaaaaaaaaaaaaaagcctgggcatgatggctcatgcttgtaatctgaacatttgggaggctgaggcaggaagatcgcttgaggtccagagtttaagtccagcctggaaacatagttagacctcatctctacaaaaataaaaaataaaaataaaaaaaacttagctaggcatgttgccacatacttgtagtcccagttattagggaagctgaggtgggaggatagcttaagcccaggatttcaaggctgcattgagctatgattacaccactgcactccagcctgggtaacagagtgaaatcttgtctctgggaaaaaaaa

SEQ ID NO: 3971 - DNA, 1071 bp, Homo sapiens
atggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtagacaattcaaagtctggagaagagggatcatgcctggatatgatctttagaaacaacaaaaatagaaaaaaataa

SEQ ID NO: 3972 - DNA, 2962 bp, Homo sapiens
cgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctc

SEQ ID NO: 3973 - DNA, 3356 bp, Homo sapiens
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaaacaccgttaacacctccgcctgcttctggtgcttccagtaccacagatgtttgcagtgtatttga

SEQ ID NO: 3974 - DNA, 4123 bp, Homo sapiens
ccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagac

SEQ ID NO: 3975 - DNA, 8314 bp, Homo sapiens
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagccc

SEQ ID NO: 3976 - DNA, 8517 bp, Homo sapiens
agtagcgagcaggttcagttcgctagtaggaagctccagcgctacaccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcatttagctcatatatgccatatagaaatattttgcatttttattgtggtctttctttggaggcacttttttcctgtatcaagttataaaa

SEQ ID NO: 3977 - DNA, 1469 bp, Homo sapiens
aagaagcctctgcgcctgcgccagggcgcacccgtcggcggtaaaagctgaggggctggcgcgggggattggtgggcgacacttttacgtctacacgtgcctacccgtctgcacgtttctgagtccgcacggttgtcttctcttgctgaatggacataggtgttttgttttgtcccaagagatacaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagtttccatttggggacctcagcagactcagggactcagtgtgaggataagggagccagtgtgaggataaggccaaagtaatggggaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaaga

SEQ ID NO: 3978 - DNA, 8269 bp, Homo sapiens
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagccc

SEQ ID NO: 3979 - DNA, 2846 bp, Homo sapiens
ggtccgggttcgcttgcctcgtcagcgtccgcgtttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatacttttt

SEQ ID NO: 3980 - DNA, 7603 bp, Homo sapiens
agcgaaggccccgcccgggccaaccgcctgcctggtccgccctctgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtacaaagattagtttcaatgtagtctgtagcctcctttgtaaaccaattaaaaagttttttaataaaaaa

SEQ ID NO: 3981 - DNA, 2184 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 3982 - DNA, 1866 bp, Homo sapiens
gactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 3983 - DNA, 1426 bp, Homo sapiens
gagccaacgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 3984 - DNA, 2238 bp, Homo sapiens
aatgcagctctgccttcctgctccctgtgcagaggtgccggctcctgcttcctggttcccagctttccttttgggaactgcctgaggtggtttgacacacagctgttgggcttctcttcccttgaggtctctgaaccagggcacccatgcagggagagggccctctgaaggtgaaggcagagacggggacgacgcagcagcaagacacggatgaccaaaggctgtcggcaaaccaccaggacacaggcctgggacagagtcacagcctcagaaggaaccaaccctgccaacaccgtgatcgtagacttcccaacctccaaaactgtgagacagtcaatttctgttgtctacgccaccaggacactaatacaaatgcctatagatgctgggcaggcagctgagacaaatggagtgggtagggctgcagctcgccaccttgagagggctctgaagagaatcaccctgaattgcagccacagtcagcagcctggagatggagtttcgccctgtcacccaggctggagtgcaatgggacgatctcagctcaccacaacctctgcctcctgggtgcaagcaattctcctgcctcagcctcccaagtagctgggactacaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 3985 - DNA, 1851 bp, Homo sapiens
gctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 3986 - DNA, 1821 bp, Homo sapiens
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 3987 - DNA, 2962 bp, Homo sapiens
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctc

SEQ ID NO: 3988 - DNA, 2325 bp, Homo sapiens
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggcccctcctggggtgatagggacccctatatctcccactcagccaaacccacagtcagtcaagtaaatcagcctgcctgtgggatgctcacccccagctcctggacatttttgcctgcctgcttcccagctgtatcccgagcgcccagaactctgcctggcatgggaggcactcaggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctga

SEQ ID NO: 3989 - DNA, 2881 bp, Homo sapiens
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctc

SEQ ID NO: 3990 - DNA, 1493 bp, Homo sapiens
atgaatggacaccttgaagcagaggagcagcaggaccagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctga

SEQ ID NO: 3991 - DNA, 3092 bp, Homo sapiens
aggtgagcgaaaggaggaggcagaatccgggcagagggcagggagagggcctgtggggaagggacctcagtcctgctcccacccgctccctggagagcaggcggccagacacccaggtcagtgctcagggaccagctcttggcccctgccccttgcaggcgctcgcatgtggctcctctcggaccccgtagtccctgtcatatcccttctctccagctgtctccatgcctgcctcgtacccctcctatttgctctcccttccactctgtcttgcctttctcgttggggtgaaaaagtcttactctcttaagtatctttcatcgcctgagtttcacctcattgaccctgtttgtctcctctcagtgtttctctggctctcagaccctatctctattgcgtttgtgattgttttgctgttttacccactgcaccgtatggggggtgggggtgtcggggaggtgtgtctttcagtctttgcatgtctgtttctgcatatccaatcccactatccattccccttcctgtgccttcttttcccccaaagcccgttatcatcacccaaccacctgtatatttcaatcctttctcttgtttatctattcctatgaaggcaaggatttggggctattttgtctcctgctgtgtttgctaggcctagcaccgtgattggcacataaagggtactgaatacttactggggaataaatgattggatgtttgcatgcccgggtctccggccccctctgggatgctggcctctgtcccgcatcctcaaggtctgcccacacctgtctgagcctgtctgtctctgatgctcctgtctcacctgccactgcccctcattgtctcctcctgtccacagcccctgcccctccctgcccctgccatggggtcctgaattctcaccccttctctcctcccttcccacagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcgcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgc

SEQ ID NO: 3992 - DNA, 2866 bp, Homo sapiens
agtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 3993 - DNA, 2683 bp, Homo sapiens
ggggaacaaaggtgagcgaaaggaggaggcagaatccgggcagagggcagggagagggcctgtggggaagggacctcagtcctgctcccacccgctccctggagagcaggcggccagacacccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 3994 - DNA, 2909 bp, Homo sapiens
ggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaaga

SEQ ID NO: 3995 - DNA, 2165 bp, Homo sapiens
gacttcgcgtagcaggcagggaactggccgcggcgagcgggactggccattggagtgctccgctgcggagggaggggaccccgactcgagctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctag

SEQ ID NO: 3996 - DNA, 1168 bp, Homo sapiens
ccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacc

SEQ ID NO: 3997 - DNA, 1403 bp, Homo sapiens
gactatctcccagcggcaggcccttcgataaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 3998 - DNA, 3293 bp, Homo sapiens
aacacgacagcggctgccgagcgacccggaagtattcccattttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcaccgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttcctccctggtcgtggtacagattccagggttggatctttggttgggtgtggcacagagtctggctcctgctaggtgagacctggccatcaaatgacacaaacaactaaacgatggaagagagagcgagcccgggtcctctaaggctccttccttctcccctggctgtcggtcacacctctgcagggccggctctctgatagaaagtggaaggcggttttagaaactcatcaccctgctctctcctggcctcgggggctgcacaggtcactgtcctgtaatgtctcccggtcagggcagcccaggactgcccagcctggtgggctggggattgggctttgggtagggcacaggtgccaccttctgtcctggctgtcctgtgccaccctggtctgtgtctagaggagtgaaactcccagggttgggctgggagtatttggtgcacgcggtatggggagggctgagctcagtgcctcctgggagacttgtcccgtgtacagtgacccagaaagatgagattccttggcctgaactctgtgatagagtgtgactgagctgctgggggacatgtgagcctcaaatccatagaaagacaaacggccaccttgggtgcccaggatactggtgcctggccccacgtacacccacatacttctcagatggctcccacattttaagattttaaaaatgaaaccaaaaaataaattgaagaaaactgtaaactttaaagaataa

SEQ ID NO: 3999 - DNA, 2420 bp, Homo sapiens
attttgcgttgtctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcaccgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctcctt

SEQ ID NO: 4000 - DNA, 5265 bp, Homo sapiens
tggcttaagccgcgcggagcagcgcaacctgggtcgctccctgcttcgccgccgcctccggaccgagccagcggagtcagtgtcctagagaccctgtaacaccacaaagcggacgaaggagtccatgttggggaacttggcagcggagtgactgggacctgggaacctactgtggggccgcggccggaccgagcgcctcgacctcggtctgaggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtt

SEQ ID NO: 4001 - DNA, 4649 bp, Homo sapiens
gaaagtgccagaaaagcgacgtcctcagggcgggagcaggggacgccgcaacgtagtctgcgagaatgcaggaaggcggcagtgaagcggtcggtcggcggggccgcggcaaagtggggaggaaactcatcccgggcaggcgtcagggtggctggagagcgcagcacgcgcgaacagaacgggggcaggcgacaggaaaacgtgtgagcgcgcggctgaaagcgactgggacctgggaaacccttttccaaagagaaatgaagaagaaaactgtatgtaccctaaatatgggagataagaagtatgaagacatggaaggtgaagaaaacggagataatactatttccactggtctgttgtacagtgaggctgacagatgcccaatatgtcttaattgtctattagaaaaggaagttggttttccagaaagctgtaatcatgtcttctgtatgacttgtattcttaaatgggcagagacactggcttcatgtcctattgaccgtaaaccttttcaggcagtgtttaaattcagtgcattggaaggttatgttaaggttcaagtaaaaaaacagctgagagaaacaaaagacaagaaaaatgaaaactcatttgagaaacaggtctcctgtcatgaaaattctaaaagctgtataagaagaaaagccatcgtaagagaagatctattaagtgcaaaagtttgtgacttgaagtggatacatagaaactctttatacagtgaaacaggaggaaagaaaaatgcagcaataaagataaataagcctcagagatcaaattggagtacaaatcagtgcttcagaaattttttctccaatatgttttcttctgttagccactctggagaatcttcctttacctatagagcttattgtacagaatttatagaagccagtgaaatcagtgcattgattaggcagaagagacatgaactggaattgtcatggtttcctgatacattacctggaattggaagaattggttttataccctggaatgttgaaacagaagtccttcctctcatttcttctgtgttgccaagaactatttttccaacaagtaccatatctttcgaacattttggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctga

SEQ ID NO: 4002 - DNA, 5296 bp, Homo sapiens
gaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactagaaactctgttgtagtttttgaaattacaacttggaggctttgaggaactgattagaagtctcctttctgtttcaggctttcatatccaaaccatagatctttagaagtaacatctgttaattaattattaataaatagtttgagtctttattaattcatggataacttgaccattttctctctccttttgcttagataatcccagatcatggccgggcacagtagctcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatgtaaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgagacactcttcacctattgtatgaccaaataaaggttatgctgcttgtt

SEQ ID NO: 4003 - DNA, 2861 bp, Homo sapiens
ggggggtgaagggtcactgctgaccggaggcagctctgccaggcagtgtcatcagtgggcttcacgtttgactgacagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga

SEQ ID NO: 4004 - DNA, 2879 bp, Homo sapiens
gggctgtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttacctgcttggtga

SEQ ID NO: 4005 - DNA, 1139 bp, Homo sapiens
gtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgccccagcccctcagggccccagtcccacagccccacacactgggagcagccagtatatacgacactgtcccggccctaa

SEQ ID NO: 4006 - DNA, 873 bp, Homo sapiens
ccgaggaggtgagtgcgcagcctgctcctccctggcccgcccaggcctgggaccctgctgtgaggtggagagaggcgacaccccgcccttgccccccacctggctctcctctaaaccccgttggggcaggctgagggaagaaggaaaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggacca

SEQ ID NO: 4007 - DNA, 4876 bp, Homo sapiens
attggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccct

SEQ ID NO: 4008 - DNA, 2082 bp, Homo sapiens
ctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagagg

SEQ ID NO: 4009 - DNA, 5798 bp, Homo sapiens
cggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccgggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 4010 - DNA, 5882 bp, Homo sapiens
aaaaatcgctgggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 4011 - DNA, 2118 bp, Homo sapiens
cggaaacatgagagaggactatcatctgctccttgctctgaatttctttgaacctccatgctggaaccctcctcagttctccatgcaaacgttaaccaggcccctttgtggtgcttggtgctgcgctggtgcagagaatgcaaagacactgtctgtggtgggaaacagaaaagcagagtgaaccacacattccagcgccgggaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggaa

SEQ ID NO: 4012 - DNA, 5784 bp, Homo sapiens
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgaatttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatatctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 4013 - DNA, 1137 bp, Homo sapiens
cgccggtgtcggtgtagggtgccgggggcagggggccctgcaggggcgtggagtggcattgtgctgtcacaggggctcgggcgtcttaggcacccatgtgggtggcgcactagaaggggcactgctctgtccgagtgctgcccttggggcgaggcgggcatgtggctctacaaggtggagtccaggcggccaaagtttggaaaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaa

SEQ ID NO: 4014 - DNA, 867 bp, Homo sapiens
gcacaatgagttgtaggcagtattaagatggctccgggggcactgttgagttgaatctggaatatcttcttacagtttcggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggt

SEQ ID NO: 4015 - DNA, 1712 bp, Homo sapiens
atcaccgggcgtccgctccggggtgccgtcgaggagacaatagggggcgtgggccctcgtttacctccctccctccctcccttccctgcgggccccgccgggttccccattgtctgaagggacggggcggtgccccagggaccagcggctttaggaccaaactgcgggcagccagggccgcgaccctccctgcgaccgtcccctggcgaccgcagctggtgattgaggggcggcgctcccgggccccacgagggttcttctgtcttcgcggccggacgcgcggacagcgtgggtggcggcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagc

SEQ ID NO: 4016 - DNA, 948 bp, Homo sapiens
gtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaagatgtacttctggactcacgggcctggggcccacccagcacagatctctgctgagcaatcttgtctccactctgttcctgccctttgcccagccctgggcctccaatctgcattgattacctggtctgatctctctcaccatcactaggtacttaataaatatttgctgttgatgatagcaatgaccttgagactgatgaacagtctggccaagaggatccttgatgtggaagatagaaaaagcctttggggtcaggcagacttggattctaataccagccagttctgcttgctgtgtctgagcctcagtttactcatctgtgaagaggaggtagcaagaatgaaaatgcctgccttgtggtttgttgtaaggacagacactgccaacgtagagggcccagcagctcacagaccagttgctctgagagcag

SEQ ID NO: 4017 - DNA, 665 bp, Homo sapiens
ggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggc

SEQ ID NO: 4018 - DNA, 1504 bp, Homo sapiens
gtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatga

SEQ ID NO: 4019 - DNA, 7673 bp, Homo sapiens
gcggcggcggcgccccagacccgaggggacgcgcgggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaactggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 4020 - DNA, 7766 bp, Homo sapiens
gcggcggcggcgccccagacccgaggggacgcgcgggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaagagattcctttattggtacaccatattggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggttataaatgaagtggagaaagcacccaaagagctgagaaaagagctcatgaaacgcaggaaagaggagcttgcacaaagccagcatgctcaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagcgccacgagaaggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcatcagctgcagaatgaaaaatgccacttgttggttgagcatgagactcagaaactgaaggagttagatgaggaacatagccaagaattaaaggagtggagagagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaactggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtggtgcctgattaatttggtctgaatatttgattctttctgttcctttcaacttgacattcagattattgactcaaggagagaggctcagagtggaatggttggcgctgtgggtaaggttggatctcccttaaaactgccttttggattcagtgtttgtgcttgagttcgctttcaaatatgaccataatcgtgtgggtgcaagactgtacagtgatacatatgtagaggtaaagcattcattttaatacttaaagttatataaatcttttcaaaaagtgttttgttataaaatacgctgtttgtacccataccagcccacctcttctgaggccctgtattcaaatagatgatagtgatctatctttcctgcatgaagtgtaggtggcgagtgggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcagacctgcacacttctgcagatccagctcctacagcttggggcactaggctgcctttcctagtcctgtcaacaaccatacagtgcgaattgctgaattagctgctattctatgtggagtcacattaagctttttcttatctttttctatggggaagctatagggtgggtaaggaaaaaatgttgaatgcttttactttgctgaaaatattagaactctcttgtgacaggatacagcaaattataattaaatataaattaccagaaccagagctacctctaagtcatacttcctcaagcacaaagctctcaggcatatgagacccaccttaatgaagggtctctgatttcttgagcatcagcgagtttcagaagtgactatttttttgtactcttctagtttccttgtaactatacactttttcccattccacactgtgcttaaatgacaaagactcttctgagaagccaaattctgtccaagtattaactagagatattgttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaa

SEQ ID NO: 4021 - DNA, 4178 bp, Homo sapiens
gcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 4022 - DNA, 3410 bp, Homo sapiens
agcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggaggctgatggatgtgctgactagtgagagtgcttgggccctcccccagcacctagggaaaggcttcccctccccctccggccacaaggtccctgggtggcacgggaggatggactga

SEQ ID NO: 4023 - DNA, 4252 bp, Homo sapiens
agtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggcctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 4024 - DNA, 4015 bp, Homo sapiens
aaaaatccgccgcgccttgacaggtgaagtcggcgcggggaggggtagggccaacggcctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 4025 - DNA, 3026 bp, Homo sapiens
tctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 4026 - DNA, 3696 bp, Homo sapiens
gttactagcagtcctggtgtgcttgttgccggggtaggcgcaacctcgcactggaggcctggcttgaagccagtgcatttgcatcagagcccaggcagggactgtccataggaagccacatggggcaatgactcatccaaggccagtcggtgatagagacctgaagagcaggttgaaagtgggagagggaggtctgtgtctgcagccccatgctttatttctgcaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 4027 - DNA, 3598 bp, Homo sapiens
aaaaatccgccgcgccttgacaggtgaagtcggcgcggggaggggtagggccaacggcctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccagtcccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctg

SEQ ID NO: 4028 - DNA, 3570 bp, Homo sapiens
aaaaatccgccgcgccttgacaggtgaagtcggcgcggggaggggtagggccaacggcctggacgccccaagggcgggcgcagatcgcggagccatggattgcactttcgaagacatgcttcagcttatcaacaaccaagacagtgacttccctggcctatttgacccaccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttgggggg

SEQ ID NO: 4029 - DNA, 1430 bp, Homo sapiens
atggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaagacagaataactgaggcctggagccac

SEQ ID NO: 4030 - DNA, 644 bp, Homo sapiens
ctcatgcctgcttgccttccagggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggagacccctgcccagggcagctctgcactccttcaaggctgcccgggccctgctgggctgtgccaag

SEQ ID NO: 4031 - DNA, 1315 bp, Homo sapiens
gagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgacactc

SEQ ID NO: 4032 - DNA, 651 bp, Homo sapiens
atggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctga

SEQ ID NO: 4033 - DNA, 9784 bp, Homo sapiens
aggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaatctttatcctgcctttgaggagctcactgtttagttggggaaaccatttgtaaaacagccattaaccatacagtgtgatcaacactgacaggagcacaggaaaaacatctagcttatgtgaagattcagagaaggcatcctgtagtctaggtggtgatacctgaactgagtcttgagggacgggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaacctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgttaattagaatttaatgaggcattagtggtggtggatgaggggtggccagaaactaaacagcaaaagcaaagagaaagctgcagaaaccataagtaagcagaggtcatgagacatttgtataatgagatcacggagccacagggtggcagaagccatgaagcagcaaggcaacaatgggctagaagccatgaagcaataggagccacgaggaacagaaaccgtgagacaaaactgactatgagatccacaaagcagcagaaggcttgaatagataagatcatgagacagtagaagcgatgagactgcaagaaccacaaggtagccagaaccatgtggcaacatggcaacaggaatggaagaggcagcaggagctacaatgcagaaaagccatggattaataggaactgaagcgccgggagccatgaagctgcaggacccatgaggcagaaaaagccatgggctagcatcgaggggggcagaaagaagttagtcagtagcagtaggaggagtataaatacagccagaaaggagttgagtcaccaatttgggaagcactagagaagggagcaacagatgcctgcagctgagggggtgacaagataagccaggctctagagctgctttggatcatgaaccattttcaagtttctgttcttccatgaggctgcctgtgtagctgttcttgtcttccttatttccctgtgaatgctttaataaatccccatcactaa

SEQ ID NO: 4034 - DNA, 677 bp, Homo sapiens
gcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccaggggtgctgtggaatctattgccatgaaaccccaaagagaggacagctctatttgaagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaa

SEQ ID NO: 4035 - DNA, 1761 bp, Homo sapiens
agttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggtggggcctggccttcagccctgttctccaaaggccatccacacattcctggcctaggtttctctgggggtggggaacttgtttcacttccccgtctcctcccagcctgccgcagggagtcaggtatagcatagagtcagacagccaggggttcagagcttggctctgccttgagtatgacattaggcaagtattttcacctctcagtgtcaa

SEQ ID NO: 4036 - DNA, 868 bp, Homo sapiens
attggtacactccaactcctttctactcttctctggaggcggcacttttgaatttcagacccagcgctccagtctttagaatgcttgaggtgtcgatccccaccccccaccgctatgtcagaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaa

SEQ ID NO: 4037 - DNA, 2390 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaa

SEQ ID NO: 4038 - DNA, 1886 bp, Homo sapiens
cgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatg

SEQ ID NO: 4039 - DNA, 7586 bp, Homo sapiens
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtt

SEQ ID NO: 4040 - DNA, 7994 bp, Homo sapiens
tcggcgggaagcggcgatcctgccaccgggaggtgtggaagagccgggtagattctggctacattggagattggttgctttctaaaactgaaggagaagcccatgaagagatggtggattctcactgagttttgactagcggaagaaaagagagagttcaagtggatggccttgaggacttgaaaagctgagatatgatgattttgaagtcatttcacatcgaagccatgatttaaatatcggcgttaagatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggt

SEQ ID NO: 4041 - DNA, 6729 bp, Homo sapiens
ctgtcggcgggaagcggcgatcctgccaccgggaggtgtggaagagccgggtagattctggctacattggagattggttgctttctaaaactgaaggagaagcccatgaagagatggtggattctcactgagttttgactagcggaagaaaagagagagttcaagtggatggccttgaggacttgaaaagctgagatatgatgattttgaagtcatttcacatcgaagccatgatttaaatatcggcgttaagatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggttcacattgaa

SEQ ID NO: 4042 - DNA, 3556 bp, Homo sapiens
agccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaaggaagaaggaggagttgcggatgatagtgccatttctaatctgctttggcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgtta

SEQ ID NO: 4043 - DNA, 6192 bp, Homo sapiens
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgctagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtactgcgtgcgtggagaggtgcccgtggaagggaatttgctggaagtggcctgtcactgtag

SEQ ID NO: 4044 - DNA, 2211 bp, Homo sapiens
atggatttctccggttgctttggaaaccagccttcagagtcagtcctgttcattagctgcggagttaacggcctctgtgctaatgaactcctctgatgtctcttctcttaagcatccttctagtttggcgtcacctactgccataaccccagtagcctcacccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcaggttagtgagcgcttgtggttttttccagctgaaagaggctggcccggcagccctgcgggagccagcttctccaatgaaccctgtcatgccctctgctgcgtccgtgcagtggggcactgcagtcatgcgcctttgagagccacctagtaaactacagagatgaaaagaagtaaggccgaattcctaacaacctagcattgccgaggccgctggtgttcacctgtagaaattgaacttgcacatcaaggcttctcagctccctctctccctcccctgcccctgtccccagagcttttctgggaaagagatgattggcctctaaatgatatttcccatgtggctgtgtgctgcttcaattaaagtcgttaagtacagc

SEQ ID NO: 4045 - DNA, 1225 bp, Homo sapiens
agctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagttttttttttaaaaaaaaataa

SEQ ID NO: 4046 - DNA, 2729 bp, Homo sapiens
ggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtaccccacatcctctcctccgggacagtcaccgaaaacacaggttccaaagtctacctggtgcctgagagcccagggcccttcctccgttttaagggggaagcaacatttggaggggatggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatg

SEQ ID NO: 4047 - DNA, 1839 bp, Homo sapiens
cgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaactctgaacctatcctcggagctctgccctcccgtcctggaacgtctttctgccctgaggagagggtagtcagcatctccaattttcagcagctcaagaaccttggcccccacaggacttcgcagatgtcacattgcccctcagtcccctgaatgcccttcggacccaaccccaattccccaagcccctgaccccctagctgccggggttcccactcccagtgccacaaccccctcacctccctggcagcccctcagcgagcctgaggcccagcacccgctggctccccagcacatggtcccctcccatgggctgttgcccagggaaccggggcgcggtgggaacgagctgctggcctcggcatgtttcaataaagttgctgtgctgggagctactca

SEQ ID NO: 4048 - DNA, 5001 bp, Homo sapiens
gacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcagtggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaagtgcctgggttgtgtgctcatttctggctgcctgaagtagtggagccggaagcccggggccctggcagagggagtgggttg

SEQ ID NO: 4049 - DNA, 1004 bp, Homo sapiens
gtttgttcctaaatctaatcgagctcccaaggaactagtatcttatagaacacacatagaaaatagtgctctacagtagtcactttcacatttttttcttggatccaacttcatgataagaaatacattttaactcataatctattcacatgtatatgaataactgaaacagaagtttcacaaaattatgattatgtttgccacaaatggtgtgctctaatattttccttctgtttcatcagaagaaaaatactggttactatccagctaagctgattttgtgacccattaatgagtttcagttctcactttgaaaacactgttctagaattacagaaaggtctagggatgagaactaacaccactgtgcatcacagtgtgtcagtctgtgccaggcagcttataaatattttttgcctctaatttttatacatttatgaggtaagtatcattttctaggtaaggatgctaatctgtctccaagccaaataacacacagtaaatcatggcaccaggatttgaatctgggtctttatacatcatagcccatgctgttctcactgtattttgctttttccaagtataaccccgttttcacacgaatggccccttcacatatttgaagactaccgtcgtgtccgtgctgaccctttctccctgccacacatggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtattttt

SEQ ID NO: 4050 - DNA, 529 bp, Homo sapiens
cccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttga

SEQ ID NO: 4051 - DNA, 4488 bp, Homo sapiens
cggcgatggtgaagttgctccttcacgacctggagcgttgcgaagtggtgctaacatgagaaggtcataatatgagaaaaacaaaacggttatcgggatgctgtgcagaacggggacatatttagaggttacaacgggatcgtaatgacttcctgttgcatagcttgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtcttttttttaatttatttatttatttatttatttttgagatggagtcttgctctgtcacccaggctggagtgcaatggtgcaatttcgactcactgcaacctctgcctcccaggttcaagcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatg

SEQ ID NO: 4052 - DNA, 1638 bp, Homo sapiens
ggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctc

SEQ ID NO: 4053 - DNA, 2280 bp, Homo sapiens
gagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 4054 - DNA, 2869 bp, Homo sapiens
tgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttc

SEQ ID NO: 4055 - DNA, 2664 bp, Homo sapiens
gagaagaagcgcttccggcggtcttagatcactaatcaacaaaccagctttcggggtctgacgcgatccttgcctcaggcctctcgaggtccagacagccgcccagcccgctctgcgacgcagcaggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctca

SEQ ID NO: 4056 - DNA, 1773 bp, Homo sapiens
gatcaactatccacgctgctcgaatcacagcatgctggagggcctggctgggtgctctgactgactgatcacctgacagacggtgcggtcagtcggatgctgagaatgactgacgatgtgatgaggggcggattgaacgagtcacaggccagctggccaggagcaaaatcggcatagctgtctgactcgatggctgtacgtggttacggactgtctgccctgatagaatctcagcttcaacgcatcagaggagactgacttgaccaatggtggggatgagtcgcctgagaaatgacagactggctgacccactgacaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccacct

SEQ ID NO: 4057 - DNA, 2871 bp, Homo sapiens
gcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaa

SEQ ID NO: 4058 - DNA, 648 bp, Homo sapiens
atggcgtggatatccagactcagagagcacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggacccggctctcctcactgtgtgtctgaaactccctgctttccctatgggaaaggcctgggagactgatctgagtgtcacagggacattgggcaggggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtga

SEQ ID NO: 4059 - DNA, 2708 bp, Homo sapiens
ctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcgggcagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccctcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactg

SEQ ID NO: 4060 - DNA, 1730 bp, Homo sapiens
cccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctg

SEQ ID NO: 4061 - DNA, 1531 bp, Homo sapiens
gggagctgtgggcaggagaggaaggaaagcagctctctcagctagcgagggggtcagggactgggccaagctcagaagcggggagaagagcgagacagagatgctctgagcaggggagacagggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtgcctgagggagagggaaaagcggatacccacctgtgtcgctgtttgcgtgccaagtccaggaacagtccatacagccctgctgcatcccacgacgctgtcacaaagcaggagttcatccgaggccaagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaagttaaa

SEQ ID NO: 4062 - DNA, 997 bp, Homo sapiens
cttatctgggcttcggttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagc

SEQ ID NO: 4063 - DNA, 1046 bp, Homo sapiens
ggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaa

SEQ ID NO: 4064 - DNA, 1690 bp, Homo sapiens
ctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaa

SEQ ID NO: 4065 - DNA, 1643 bp, Homo sapiens
ggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaa

SEQ ID NO: 4066 - DNA, 191 bp, Homo sapiens
tggaggcgactagccactgtggaagagaggaagaaaatagttgcatcgtcacatgctttgatgaccatgacccagctgtgatccatgagaacgcatctcagcccgaggtgctggtccccatccggctggacatggagatcgatgggcagggctagtaacagtttttaaataaaaggcaacaggtcatgttc

SEQ ID NO: 4067 - DNA, 8823 bp, Homo sapiens
ggaagagttctagcctgaaagggaactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaggcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccggccagtccccacagcctcatcagctctcttcaccgttttttgatactatcttcccccacccccagctacccataggggctgcagagttataagccccaaacaggtcatgctccaataaaaatgattctacctacaacctctgcctggcttcaagggagatacaagttttctcccagggcagtaggagagacagtggggttgaattctgtcacccagcttgatccagcttgaaatgggagaggggaagactggcagtctgcacctgaggtcccttcctccttgcacccggaccctaaagttatccaatggggaagttgtgcctgagaagtcatactcctgttatcctcacctccctggccagcacctaagcctcacaaagtgtcgttctgctgctgctgggacagcagctaccacagttccttgtggctaccaggacattctgttcttcatagctactcagggtatgtcaacaaatccagtccttgaccaaattcaaattttcaaaagaagctttgctaaaaataa

SEQ ID NO: 4068 - DNA, 8098 bp, Homo sapiens
ggaagagttctagcctgaaagggaactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaggcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctcccctccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagctagatgaaggaccaatgggtgaaccagaaggttccttcgtggattaccaaacaactatggtgcggacagccaaggccattgcagtgaccgttcaggagatgataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcgccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccggccagtccccacagcctcatcagctctcttcaccgttttttgatactatcttcccccacccccagctacccataggggctgcagagttataagccccaaacaggtcatgctccaataaaaatgattctacctacaa

SEQ ID NO: 4069 - DNA, 9620 bp, Homo sapiens
agtgacagtgctaggggagtccgaagatggcggcgtcgcgtcgctctcagcatcatcaccaccatcatcaacaacagctccagcccgccccaggggcttcagcgccgccgccgccacctcctcccccactcagccctggcctggccccggggaccaccccagcctctcccacggccagcggcctggcccccttcgcctccccgcggcacggcctagcgctgccggagggggatggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtgagcggggccctacgggaactgctggaggcctgtcgcaatggggacgtgtcccgggtaaagaggctggtggacgcggcaaacgtaaatgcaaaggacatggccggccggaagtcttctcccctgcacttcgctgcaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacattagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggtcacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgagaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagta

SEQ ID NO: 4070 - DNA, 6157 bp, Homo sapiens
cgcgccgcctcgctagccgaaacctgcccagccggtgcccggccactgcgcacgcgcgggacgacgtcacgtgcgctcccggggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccacgcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtt

SEQ ID NO: 4071 - DNA, 3339 bp, Homo sapiens
cagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaa

SEQ ID NO: 4072 - DNA, 1421 bp, Homo sapiens
cagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgagggtcggaccggaggagggacagggaggtggggggggtcctcaggtcgctgggctggtcttttgctgagccacccgctaacctga

SEQ ID NO: 4073 - DNA, 5001 bp, Homo sapiens
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaaacacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggg

SEQ ID NO: 4074 - DNA, 5008 bp, Homo sapiens
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagccacagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaaacacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaagggg

SEQ ID NO: 4075 - DNA, 4641 bp, Homo sapiens
cgttttcttcgttgcgtacgattgtgctccgttggtgttctcagcagggatctgattctatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaaacacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaagggg

SEQ ID NO: 4076 - DNA, 3910 bp, Homo sapiens
ttccccacagatacaaacttccaaccagcacgtaggtttccaggctaacccacaaaagcaagttgagtctagctcctccatattgatccacaccaatcatagctattctgaaatgtactttcctcacatctgtaaaatagggagaatactcatctcgaaggattggtgtagagtttatattgttctccataatactaacatctgtcttgttgtatttgcttctttgcttattgtctgaccccctctatagaatgtaagcttcatgaggtcaggacctttgttttgttcactgctatgtcccccatgcctagaacagtgcctgacacatagtgagtacagtactcaataaatattattgaataaagagatacattctttgttattcacccaagatgaccatattttgttgtttggggctgtattcttcaggagagaacagaaatgaataagccactctctgcctccaagaagatctcttcaagtggaggtgacagacatgcccaaagcaaatagattgcaataagacttgatgggagagaatgtgagtcttcacatcctagcatctttccagatagagacagggcctacccaaaagtctaatctgaaactgaactgaaatagaacagaaatagatcccaagtgatggaacctgtgcctttcccaaagcttggcttctaaaaggtagcaaacattttctactggagaggggaaagacaggaagaagaaaaagggagtttcctccttttctcttgggctctcagccagacagccactggcaaaacgttggaaaggcctaaatttgtcctggatgcacttccctgatcctagtcccaccaatcccagcccccacggccttaagcccctatggctccctcccaagattccaaacgtaagaaaagaacacacaccacagtccaaaggcttcttgtctggaatagccaaccctggggtaattgttaggtggaatgcaatctggttgaattcattcaaacactgtaggaattgcctctttcgaaccctgtaggattttacttcttgacgcatctgtttatttaaaaccaaaggggtatgttgaggcatgggcaccctggcagcagaccccaaaccaaccctcttgacttgtgcctgcctttcaggatatgttcccttcctgaatttgtctaagaaggctgagttggggggtggttgctgatttttataacatatagccagttgttcataggcctgtgttttaaagaagggcaagcctgaactcaccgtcctgcctcagggcctgggctccatacctggggagtagacagtcttctactttctaaaaagctggacttgaaatttggagtaaatctcctggttgagtgacaggtgtttcgcagctgagcccttgaggagattctccagttgggcagagacatcccttcctcagacgccttgtgggctggactcctttggcccagttcaaagtgaggggagggctcccaacaggccgggaagacagttgacttcaccctccttgggtttgtctgtctgtccgtctctgggaatggtcgcttcctgttttcccttttccttttaagcctcgccttgttcccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctccggatccgg

SEQ ID NO: 4077 - DNA, 1838 bp, Homo sapiens
tcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtaacggcttgttcccggtgcagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcact

SEQ ID NO: 4078 - DNA, 1395 bp, Homo sapiens
gtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcggaatcagcttctatccttgacttagattctggtggagagaagtgagaataggcagcccccaaataaaaaatattcatgg

SEQ ID NO: 4079 - DNA, 1391 bp, Homo sapiens
gtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcggaatcagcttctatccttgacttagattctggtggagagaagtgagaataggcagcccccaaataaaaaatattcatgga

SEQ ID NO: 4080 - DNA, 717 bp, Homo sapiens
ccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtgagctccactggagcctgacccctcttagtccacagtggctgtatcagaaagaaagaccaccccttctccatgaaggcagtgctaacccctccccgactgctgccatctgagggtccctagggatgggagaggcttcctggaggcactcatgtctcccttaccacttcgggagccaagggctttgtaggcagccccctttatcgcagctgctcatatctataaagtacttcacaagtttcagctggcactttcatttaccattgcttttttttttttttgagatgagtctggctctgtgg

SEQ ID NO: 4081 - DNA, 872 bp, Homo sapiens
ggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaa

SEQ ID NO: 4082 - DNA, 1846 bp, Homo sapiens
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtatccatggagaaacagaggctgactaaagcaaatagtgacata

SEQ ID NO: 4083 - DNA, 4760 bp, Homo sapiens
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcat

SEQ ID NO: 4084 - DNA, 3935 bp, Homo sapiens
agacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattc

SEQ ID NO: 4085 - DNA, 4333 bp, Homo sapiens
gcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatataactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactca

SEQ ID NO: 4086 - DNA, 3836 bp, Homo sapiens
ttattctcagtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctgcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattct

SEQ ID NO: 4087 - DNA, 10695 bp, Homo sapiens
ggaatcggacgccccaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgcgaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcggatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcatggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcacgtcggatctcagaactgaagagctacctaagcagacagaaagggatcacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttagccaggtgtggcggcgggcacctgtagtcccagctacttgggaggctgaggcaggagaatggcgtgaacccaggaggcggagcttgcagtgagccgagacaccactgcactccagcctgggcaacagagcgagactctgtctaaaaaaaaaaaaaaagaactacccagatgagaggtgaggagccaagccattgaaagcggaacaaaccttctggttttcccaacttctgacacgactttcaactttagtcaatatggtaattggcattctcagaagagatcacgaaagtgtcttactctctctcaaattgaaattcacaaagattaaaactaattgagaggtggcacaatcatagccatgaactctgattttcttaagtaaaaaaccttttttttttttttttgtttttgagatagagtctggctctgtcacctaggctggagtgcaatggtgcaatctcagctcagtgcaacctctgcttcctgggttcaagcgattctcctgccttagcctcccgagtagctgggattacaggtgcccaccaccacgcccagctaatttttgtatttcagtagagacgaagtttcaccatgttggccaggtgggtctcaaactcctgacctcaggttatctgcacacctcagcctcttaaagttctgggattacaggcgtgagccattgtgcccggcccataaaagaactttattatatttctaaaattcaatcatatggaagaatctattgagcaggttagcctttgcttaactttcctcctctgttactccagccttagctggggtgttttgtagaattttcagagcatgggagacagacaactagagcttcctcctgcccttggcccatgcttttaggagagcaaaaggcaaaagattgaaaccactgactttagtttcctcaggccctttctttctgagggttaaagaagaaggaaatgtcttctgtggccaagaattcaaggacttgtaggagataagtgaaggctattacagggattttgtcctggtttggtaggtttctcttggagaaataccactacaccctggtctagaaatgagttttgaagacttggggagttaaagggcactgagttttactctcactgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaactatggcatggcatcatcctagtcattgatttcaatcttttgccttttgctcccctaaaatcttgggccaattgcaggaggaagctctatttgtctctcttccatgctctgaaaattatataaaagcatcccagctaaggctggagtgaaggggttggggaaagttaagcaaaggctaacttgaccaataggctcaatagattcagtcttgttggccaggcccacttgaagggttttttgtttcatcttggagaaggacagtgaggtcatggtataattgttatgagtaaagtcaagaacagcttctaggtaaaagtaattatgtacccaaaaggagttgaagggaaaatcaatttaggtttacattaaacatccttcaagttcttatctttaaatggagtttcagtgtctcccaaaggctggatgagttttacagttataaccactggattgtgagaccataggacatttgaacaatcttttcttctacccatctagaaaagcatcttttttatataccaaatttttacacatatatccacatctgtttttgaaatctagagcagaggtactcaaagtttggttcatggactagtgccagttcacaaattgttaatgttttataatgagataagtacggaagttgagagtaaccatttagaaactgtgtaggaatttaaaaagtaatatctgacaaatttaataataaaaatggaggcttgta

SEQ ID NO: 4088 - DNA, 10670 bp, Homo sapiens
gaatcggacgccccaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgcgaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcggatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcatggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcacgtcggatctcagaactgaagagctacctaagcagacagaaagggatcacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgctctgatgggatcctatggaacctggccaaatgcagcccagaaggagaatggaccacaggtaacatgtggcagaaaaaagaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttagccaggtgtggcggcgggcacctgtagtcccagctacttgggaggctgaggcaggagaatggcgtgaacccaggaggcggagcttgcagtgagccgagacaccactgcactccagcctgggcaacagagcgagactctgtctaaaaaaaaaaaaaaagaactacccagatgagaggtgaggagccaagccattgaaagcggaacaaaccttctggttttcccaacttctgacacgactttcaactttagtcaatatggtaattggcattctcagaagagatcacgaaagtgtcttactctctctcaaattgaaattcacaaagattaaaactaattgagaggtggcacaatcatagccatgaactctgattttcttaagtaaaaaaccttttttttttttttttgtttttgagatagagtctggctctgtcacctaggctggagtgcaatggtgcaatctcagctcagtgcaacctctgcttcctgggttcaagcgattctcctgccttagcctcccgagtagctgggattacaggtgcccaccaccacgcccagctaatttttgtatttcagtagagacgaagtttcaccatgttggccaggtgggtctcaaactcctgacctcaggttatctgcacacctcagcctcttaaagttctgggattacaggcgtgagccattgtgcccggcccataaaagaactttattatatttctaaaattcaatcatatggaagaatctattgagcaggttagcctttgcttaactttcctcctctgttactccagccttagctggggtgttttgtagaattttcagagcatgggagacagacaactagagcttcctcctgcccttggcccatgcttttaggagagcaaaaggcaaaagattgaaaccactgactttagtttcctcaggccctttctttctgagggttaaagaagaaggaaatgtcttctgtggccaagaattcaaggacttgtaggagataagtgaaggctattacagggattttgtcctggtttggtaggtttctcttggagaaataccactacaccctggtctagaaatgagttttgaagacttggggagttaaagggcactgagttttactctcactgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaactatggcatggcatcatcctagtcattgatttcaatcttttgccttttgctcccctaaaatcttgggccaattgcaggaggaagctctatttgtctctcttccatgctctgaaaattatataaaagcatcccagctaaggctggagtgaaggggttggggaaagttaagcaaaggctaacttgaccaataggctcaatagattcagtcttgttggccaggcccacttgaagggttttttgtttcatcttggagaaggacagtgaggtcatggtataattgttatgagtaaagtcaagaacagcttctaggtaaaagtaattatgtacccaaaaggagttgaagggaaaatcaatttaggtttacattaaacatccttcaagttcttatctttaaatggagtttcagtgtctcccaaaggctggatgagttttacagttataaccactggattgtgagaccataggacatttgaacaatcttttcttctacccatctagaaaagcatcttttttatataccaaatttttacacatatatccacatctgtttttgaaatctagagcagaggtactcaaagtttggttcatggactagtgccagttcacaaattgttaatgttttataatgagataagtacggaagttgagagtaaccatttagaaactgtgtaggaatttaaaaagtaatatctgacaaatttaataataaaaatggaggcttgta

SEQ ID NO: 4089 - DNA, 2698 bp, Homo sapiens
ttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacagtcttcacctgaaccgaattctacaggaggacttaggggtgctgacaagtctggattgggctcctgatggtcactttctcatcttggccaaagcagatttgaagttactttgcatg

SEQ ID NO: 4090 - DNA, 581 bp, Homo sapiens
ctgctgcgggaatcggacgccccaggtcaggcacccagggtttccagccccagtctaaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggacta

SEQ ID NO: 4091 - DNA, 3268 bp, Homo sapiens
agtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatgagtaccatatacttcctgactcctttatcttgttacaccacaagatactgcactatttattggagatattttgatgattagtgccaaggctggcatcatgagccaaaatagacttgttaagtcaacctcattccaaacacctgctatagatcatcaaatctaagttgccattaattgtaagatgtcctgttatttcacacacacaactagaaaagaaaaatcggtatcaattatagtatggtgctttcttattttgaattttacttattagaagagctattttagatgtatttaaacataagatttttatcacataacttgtggatacaaaaaaagagaaattgtaagcaaaataagttgggtaatatattcctaaaacctc

SEQ ID NO: 4092 - DNA, 1677 bp, Homo sapiens
agtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaagtgttagtgacaaacagtctgcggtaactgaatcctcagagggtacagtatccttattgaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctc

SEQ ID NO: 4093 - DNA, 669 bp, Homo sapiens
atattttctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaagt

SEQ ID NO: 4094 - DNA, 2951 bp, Homo sapiens
gggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtagagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaactgtaa

SEQ ID NO: 4095 - DNA, 2175 bp, Homo sapiens
actctcgatgcgccgcggctgctgctgcgcaggcccagtgctgcgcttcgcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgagtctcgtc

SEQ ID NO: 4096 - DNA, 13132 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagctccagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccggc

SEQ ID NO: 4097 - DNA, 13125 bp, Homo sapiens
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 4098 - DNA, 3125 bp, Homo sapiens
ccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccactgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccagagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcctggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 4099 - DNA, 1339 bp, Homo sapiens
tgtgcacagaagttatatacatatatgggtatatctatgtaacaaatcgcagcacaggagtcccctgggctccctcaggctctggtatgacatatttgagccatataaattcagcttctcctctggcatctgttagccgactcacttgcaactccacctcagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaa

SEQ ID NO: 4100 - DNA, 1852 bp, Homo sapiens
ctcttaccgcccttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagaattgcttggattgctacatggaccccctgagactatcattattacctcctagggccaggaagccagtgtgtcctccgtctctgtgcagctccgtcattaccataggggacttggttttagactctgatgaggaagaaaatggccagggggaaggaaaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 4101 - DNA, 2168 bp, Homo sapiens
cttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 4102 - DNA, 1861 bp, Homo sapiens
cgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgct

SEQ ID NO: 4103 - DNA, 1674 bp, Homo sapiens
agacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaagacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagaattgcttggattgctacatggaccccctgagactatcattattacctcctagggccaggaagccagtgtgtcctccgtctctgtgcagctccgtcattaccataggggacttggttttagactctgatgaggaagaaaatggccagggggaaggaaaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgtt

SEQ ID NO: 4104 - DNA, 9233 bp, Homo sapiens
aaacagaaggtgggccggggcggggagaaacagaactcggtcaatttcccagtttgtcgggtctttaaaaatacaggcccctaaagcactaagggcatgccctcggtgaaacaggggagcgcttctgctgaatgagattaaagcgacagaaaagggaaaggagagcgcgggcaacgggatctaaagggagatagagacgcgggcctctgagggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattt

SEQ ID NO: 4105 - DNA, 9679 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 4106 - DNA, 9215 bp, Homo sapiens
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattt

SEQ ID NO: 4107 - DNA, 865 bp, Homo sapiens
atcagctgtagggtctgggtctgggtttgtgtctgcctcctcctaccttcttatccccctttagggggctgtacgaagtgaatgtcacagggagtggaattggagtacactgagtgggttttttttttccttaagtccgcgcgttttgttagcggcgctgagtgaaagaggaaagaatagtttctctggttccccaaacaagaccagaactcacttttctcaaggtacataagtcagcgctgggctgagccttccagcctggggaatgtatgtaagagaatttatggacaaatctgtgtcccggctttgtgcttctcccgaatcagcttcgtttggttccttggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaag

SEQ ID NO: 4108 - DNA, 4935 bp, Homo sapiens
gaaaggagacccgactgcaactgctggattgctgcaaggctgagggacgagaacgagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctgagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgtt

SEQ ID NO: 4109 - DNA, 10166 bp, Homo sapiens
ccgtgccatcccaacctcccacctcgcccccaaccttcgcgcttgctctgcttcttctcccaggggtggagacccgccgaggtccccggggttcccgagggctgcacccttccccgcgctcgccagccctggcccctactccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcaaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaagtgttgtcttcct

SEQ ID NO: 4110 - DNA, 10075 bp, Homo sapiens
ccgtgccatcccaacctcccacctcgcccccaaccttcgcgcttgctctgcttcttctcccaggggtggagacccgccgaggtccccggggttcccgagggctgcacccttccccgcgctcgccagccctggcccctactccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcaaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaagtgttgtcttcct

SEQ ID NO: 4111 - DNA, 10166 bp, Homo sapiens; identical to SEQ ID NO: 4109

SEQ ID NO: 4112 - DNA, 2093 bp, Homo sapiens
acctgctcctggggaaactacaccaaggccgccgctctggcctggggctccctcccacacggccttggccctctccccctcgccccgggaccgctccgcccctcccggatcccggtcggcggagcgcatttatttgcatatttctacctttgttccctgccagcggccaatcagcgcgcggggcgagacgaaggggctgggcggggctcgggctcctgctccggctcagctgcggcggccgcaggttccaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaa

SEQ ID NO: 4113 - DNA, 2206 bp, Homo sapiens
agttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctag

SEQ ID NO: 4114 - DNA, 1099 bp, Homo sapiens
atactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctat

SEQ ID NO: 4115 - DNA, 5217 bp, Homo sapiens
ctcggggccacggtccccccgcagcgctagtcccgggcccgcgagcaccggcccccgccacccgcaggttgcggagggaggagggcgggagcgggcggcgcggagccgggaggcgggggaggggccggcgtccgaggcggcggcggcggcggctggagcagcctctggcagcagcggggagaatgggagtgcggggcgccagaccgccgcggggtgtcacggccgccacgaagcctgcgaggcgcggggccggcgcccgcggcttttaaacccgggaaggcgcggcggcggcggcggcggcgggcagatcgcggcgcgcaccaggcgccggggcggcggccgaatggagagaaagggctcggcggccggggccaaggggaacccgagcccgcccgcggccggagaggggcagcggccaccgccgccgctgtgcgtcccgggcggcggcggaggagccccagcgaggggccaggtcggggcggcggccgagccggccgagctcatccgacgagcgcacgagttcaaaagccaaggggcgcagtgctacaaggacaagaaattccgtgaagccataggcaaataccaccgggcgttgctggagctgaaggggctgctgccgccccccggggaacgggagcgggactcgcgcccggcctccccggctggggccctgaagcccggccgcctctcggaggagcagagcaagacggtggaagccatcgagatcgactgttacaacagcctggcagcctgcctgctccaggctgagctggtaaactatgaacgagtcaaggaatattgcctcaaagtcttgaagaaggaaggggagaacttcaaggccctttaccggtctggtgtggccttctaccaccttggggactatgacaaagcactctactacctgaaagaagcaaggacccaacaaccaacagacaccaacgtgattcggtatatccagctgacggagatgaaactcagccgatgctcccagagagaaaaagaagccatgtaaccaggaagcagctccagagctgcgcccacgcctgaccggggacttccaggcatcccctggcagagagccccgtcctggattctgtccctttctccccacttcttctggctcctcatttttcctcctgttgcaccccagctctttgtctcctcccagtacgaaaaggagagatgcaaatttggaatctggtaggtcgcccagacaatggagacatcctctcctctagcaggtcagcgactgagaggggcctgacttctgctgggacagctggagaggagtctcatgggctgggatgctgttgtggctttgactttggccagtgcttctgacagaggcggagcctggcaagtgtaccatcccacaggcagcaggcacacagcccatgggctggatccttccacactttcctgacagaccagaaccagagcatctcgaggcaactgttagaaatccagggacgagacaaacagagaagcgctggtgaagccaacatagagactgtcaatgtgtacactggagttcccacccccaccccccacccgtcacttagcccctgcctccttcccccactcgttgtcttggcttgtgctttctcctctccccatcggggatccgagactctgccaggattcacatgccactgaagcccactcagtgccctctggtgaccacacataccattcccccggactcccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaacaaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacaccgttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatctttacatgtataatctcatttctttcatgcagttactctgggatactgttcccatttgatgggtaagaatattgaaaaccagaaaaattaattatcccaaggttgcatggcctttagtggcatagctaggatttgaaccaggcctgcctgactccagagctctggctagtatctatgctatacttagttgcctctctgtaagtataatattgggcaattataaccatttgagaacaggacaatatgtattaacctgaaaagtgttcatgatgtcagtgatagtacatggcctccttatgtatttactcaagggccccaaaagaccagaggccagaatccctagtagtcagagcagtgacaggtcagaaaaaggcagctgaggtccaatagttatgtctgtgtattgctcattctacttactgatggagccagcatgtatctcaacaactcacctagcattcatcacccatccccagcattgggaaagggtcacaattaagaccgaaaggaaacacaaagttaaatatgggttaattatgtaagcagatgccccaccacggcaggatccaatcacagccgaggggcccagaagagagcagcgtaagttatattcacatagttccccaaaggctttcaacgggggctacaggaaggtgctagaaatattgaggggcctgccattactcacctagagctcactctctggagaagaggaaaaggaagaagctatttcagctgccacattctccccaatccctactatattatgctgtctttcctcttcctcctagctggctttacatgaccctaacccaaaactaccctatggccccacacgggaatgtgttcaaacgccccgacccccacccccacccccattcccaagcctccaacttagaacgtttgtgatttggcagatggtttgttaggatctgaaggatgaagagaagggtagaggtcacctggagaatgagttcaaactgccagggtcttcccttggtctttgtgcgtcaggaaggactccgagtaattattccctatgcagagacaggagagaggtcttgtttacatgagtgtgctggggcagggctggacaatccaggatatgattgtagccatcccatgtagaaagatcaaaaaccagaacgaaatgaagacagcctctcagaacctcatagaacaagcgtccaggtcatctgcttgtttggtgacttagatatacaggcttactggaactccattcactgtgacctgaagttaaataatcccaaagagaaaaagctacctggggtattggttgatgtttggggtgatagggctgaattttctgtgcatttgtccaacaaaggctttagagcacaaaaccaggttcattctccctaccaaatcttcagcttccttctcctcatccctccccaaaacaagaactgtgatttaattccgtacgttgcggatgtcactgctgacctatgtagctggagtactaatcaggcatctgacctgcactgtcatcccctgcctggacttttgcgatggactctttgggggaaaaactaacgctttttaattattgtgaaagcatcatgtgtgtattgtagaagttttaggaaaaaaaggacaaaatccaatccataagcttaccacccaagacaaacgtgtattcttttgaatataccttttagttctttttggtgtaaatgtacacacgcacacacagttgtggatttttttaaacaaaaactggatacactgaatatactctttaataacttttcaagtgtgtatttatattttagaatatgtaatcctacacagatacaaaattcaaaaagtacaaactgctctgtagtcagaagtaaatcttctccctaccccgtctgccagcatctagtttccctctaatttattttgcatcctagtggagatgcttacacattgtcaaacatatgtatatattcttttatcacacacaaatggcagcatattggacactttttgttttttgctccttctgttccttcacttaataatatcacgaacattttcggcatatcaaactttctcaacagcatcttcattgtatggatggaccctttttttatcatcaatcctcaaatagtgattatttcatttgttcccaatcttcattgtaaatagtgttgcaactgacattcttgtagctaaattttgcacatgtctataacgatttccttaggataaactccaagaagagacttgcttggctatttttaagaattttgatacatgttgccaaccaccctccagaaagtttgtaccaaaacgctctcctatttggatcctagagagtaccctgtttcctgcaccctaacactaggtatcatcacttatcaaatctttcccaatttggtagctgggataatagtatgtcaatgttattttaactttctttgattcttcgcgaataacattttcatatgcttattgaccatttgtacttctttctttgtgaattttctatttatttgatattggtatgtttattatcaatttgtaattttattaagaatattatttttgtcaagaaatgctgcaaatatgctttccaagtgctttgctttcaaattttgtttatggtgctttttgacatacataaattcttaattctgc

SEQ ID NO: 4116 - DNA, 635 bp, Homo sapiens
tacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcatgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtt

SEQ ID NO: 4117 - DNA, 869 bp, Homo sapiens
ctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtt

SEQ ID NO: 4118 - DNA, 2927 bp, Homo sapiens
gacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaa

SEQ ID NO: 4119 - DNA, 3790 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 4120 - DNA, 3858 bp, Homo sapiens
agtgtgcggatttgccggggtcagactccaagcttgattgtgagttctagcctttgtcagaaatgcagcaagtcatgctaacttgcaagggagtcaacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 4121 - DNA, 3900 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 4122 - DNA, 3488 bp, Homo sapiens
atgttgtccaggctggtcttgaactcctgggctcaagcgatcatccggcctcggcctcctaaagtgctgggactgcaggtcacgacatttagtgaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 4123 - DNA, 3701 bp, Homo sapiens
atgccagttgatgactactggctgtgtttaccagcctcttgtgctagaccttttgtgcagactgtcagagtggtgcagtcttgcccccactgttgctggtttccaggtgttctcccttcagtccctgagccactacgtatgcccgccatgctgccaacaggtagccacagtgctgtgcttcctccttcacattgctccaccgcacccccttccacatcccaagaaccttcttcttccgctgaccccaagctctgcctttcaccccctacatctgatagtaggcaagagagaaatgtgcagtttgggctggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 4124 - DNA, 3828 bp, Homo sapiens
ttcccacagggccttgtgcgacatgggctgcgccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 4125 - DNA, 3930 bp, Homo sapiens
agaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 4126 - DNA, 1933 bp, Homo sapiens
aggctggcggtttccttcctcttggtctttgtagagacagtttgcagaacagcggagaaaatggaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggca

SEQ ID NO: 4127 - DNA, 3836 bp, Homo sapiens
agttcccacagggccttgtgcgacatgggctgcgccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 4128 - DNA, 577 bp, Homo sapiens
gaagaagctaaatcaagcctctgagtttcaccttggaagggcctggcaggacctggcagtggttgcctgtttgtttagagggagtgtggcttctgctggctgttaggagcccgcaacgctctcagctgagagtgcttcaatctggcattatccaaagaacagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatg

SEQ ID NO: 4129 - DNA, 3808 bp, Homo sapiens
tagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggggtaggggacccggaaaccccagggtctggaggagagcaaccaggaagctcttggggtgacttcgttttccttcagagatggaggtctcattatgttgtccaggctggtcttgaactcctgggctcaagcgatcatccggcctcggcctcctaaagtgctgggactgcaggtcacgacatttagtgaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggc

SEQ ID NO: 4130 - DNA, 400 bp, Homo sapiens
aggtggtcgagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagc

SEQ ID NO: 4131 - DNA, 3974 bp, Homo sapiens
acgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 4132 - DNA, 1847 bp, Homo sapiens
actgtcagagtggtgcagtcttgcccccactgttgctggtttccaggtgttctcccttcagtccctgagccactacgtatgcccgccatgctgccaacaggtagccacagtgctgtgcttcctccttcacattgctccaccgcacccccttccacatcccaagaaccttcttcttccgctgaccccaagctctgcctttcaccccctacatctgatagtaggcaagagagaaatgtgcagtttgggctggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatcc

SEQ ID NO: 4133 - DNA, 786 bp, Homo sapiens
accttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggggtaggggacccggaaaccccagggtctggaggagagcaaccaggaagctcttggggtgacttcgttttccttcaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaata

SEQ ID NO: 4134 - DNA, 607 bp, Homo sapiens
acacaaagcttcagcatgtcatgtggtaggtgaggccggcgcctgtaggctggcggtttccttcctcttggtctttgtagagacagtttgcagaacagcggagaaaatggaggacggtcgggccctggaaggaacgctctcggaattggccgcggaaaccgatctgcccgttgtgtttgtgaaacagagaaagataggcggccatggtccaaccttgaagtgctttgtattgaaggaggaaccttggccataatgccagttgatgactactggctgtgtttaccagcctcttgtgctagaccttttgtgcagactgtcagagtggtgcagtcttgcccccactgttgctggtttccaggtgttctcccttcagtccctgagccactacgtatgcccgccatgctgccaacaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatgg

SEQ ID NO: 4135 - DNA, 554 bp, Homo sapiens
attaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggggtaggggacccggaaaccccagggtctggaggagagcaaccaggaagctcttggggtgacttcgttttccttcaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaa

SEQ ID NO: 4136 - DNA, 728 bp, Homo sapiens
tttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaagagatggaggtctcattatgttgtccaggctggtcttgaactcctgggctcaagcgatcatccggcctcggcctcctaaagtgctgggactgcaggtcacgacatttagtgaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacaggtatg

SEQ ID NO: 4137 - DNA, 2048 bp, Homo sapiens
actccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcat

SEQ ID NO: 4138 - DNA, 1933 bp, Homo sapiens; identical to SEQ ID NO: 4126

SEQ ID NO: 4139 - DNA, 1877 bp, Homo sapiens
gctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 4140 - DNA, 1813 bp, Homo sapiens
gtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgcccc

SEQ ID NO: 4141 - DNA, 1105 bp, Homo sapiens
gcctgtggaattgtcctgagtcattgctttgggctggggccatgggaagaaaccattgtgtggcagggaaggaggtggctcttggcccaggcctaaaccaggaaagcctgggaaactgggacccacagcgagagccgcgggagagtgtgcagccgagtcactactgcctgcctgcctgcctgctacggctcagcagcagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 4142 - DNA, 1493 bp, Homo sapiens
gtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgcccc

SEQ ID NO: 4143 - DNA, 1200 bp, Homo sapiens
tgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgcccca

SEQ ID NO: 4144 - DNA, 629 bp, Homo sapiens
ggagagtgtgcagccgagtcactactgcctgcctgcctgcctgctacgagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 4145 - DNA, 7775 bp, Homo sapiens
agctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataaaaacatctatttttaataacactttctatctaaatcagggtgactttttaaaaaaaatccggaagctttttgttgaattacgttacagacttagttaccagtccttgttagagttaccttcagttgacatgctgtgaatggtcccacctcttttatggcagaattcattacttaaaataactctattttcttcccccttacctaaataacagaaaggctcactatgtcccaaatatcattggcagaagcaaactataaagtcataagccctttgcagtgcaagtctagaaataatttt

SEQ ID NO: 4146 - DNA, 582 bp, Homo sapiens
agccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctg

SEQ ID NO: 4147 - DNA, 1235 bp, Homo sapiens
gaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtg

SEQ ID NO: 4148 - DNA, 5811 bp, Homo sapiens
aggaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctatacatga

SEQ ID NO: 4149 - DNA, 1291 bp, Homo sapiens
tgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagttatc

SEQ ID NO: 4150 - DNA, 437 bp, Homo sapiens
acattctgctccggtaacccatgcctgtggctcgctgggctaagtcagcccctggtgaagtttcatttgccgaattcatctctcatgacaacccgatgaggtgggcattttacatgacgctacgtttcattctacggatgaggaaactgagacagagaagttaagagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggctt

SEQ ID NO: 4151 - DNA, 1630 bp, Homo sapiens
cccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 4152 - DNA, 1614 bp, Homo sapiens
gccgccgccccgccgccggcagtggaccgctgtgcgcgaaccctgaaccctacggtcccgacccgcgggcgaggccgggtacctgggctgggatccggagcaagcgggcgagggcagcgccctaagcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgc

SEQ ID NO: 4153 - DNA, 1608 bp, Homo sapiens
gcgcgaaccctgaaccctacggtcccgacccgcgggcgaggccgggtacctgggctgggatccggagcaagcgggcgagggcagcgccctaagcaggccgcagaccccggacgtgtcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 4154 - DNA, 3251 bp, Homo sapiens
agtacgcgtgggatttggctccgaggaggcggaagtgcagcacagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgtttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaa

SEQ ID NO: 4155 - DNA, 1014 bp, Homo sapiens
aattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccaggtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatg

SEQ ID NO: 4156 - DNA, 3294 bp, Homo sapiens
atgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgagagtcttgctctgttgtccaggctggagtgcagtggcacgatctcagctcactgcaacctccacctcctgggttcaagcaattctcctgcctcagcctcccgagtag

SEQ ID NO: 4157 - DNA, 5894 bp, Homo sapiens
gacccggtagtcgaccgtggaccgcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaataggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccattcatgcctcccct

SEQ ID NO: 4158 - DNA, 6310 bp, Homo sapiens
ggaccaggcgcctgcgactcttctcagacgccgacgtgcacgaggtttggctcccaggtgtcctgcctgccagacccgcggtagctcggctcggccagttttgctagggctgcctggcgagccacaccaattcccatcctttggtatcgccaggattcggcggctgtgaaactgatttccggtcgctaaggtctccatggagacagcactttaaccactttctcccactgtcattcctcgactccacgtggttcagaaatcgcccagagaatgtttgtgggagtcagccaggaaggtgtagagtgaagcagcgttctaaagggaagcatgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccc

SEQ ID NO: 4159 - DNA, 6114 bp, Homo sapiens
gacccggtagtcgaccgtggaccgcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccattcatgcctccccta

SEQ ID NO: 4160 - DNA, 6026 bp, Homo sapiens
gacccggtagtcgaccgtggaccgcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcatctcaaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccattcatgcctcccct

SEQ ID NO: 4161 - DNA, 3043 bp, Homo sapiens
gcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatgggtttgtattgatgtttgctcttatcaaaacgaatagcttagtctcagtattcatttggttagaatatctaatggttaaacatatattttgtggttttttatttaaaagtttatcagcatataagagcaccatgggttctcattatgcaaatgaacattttagtcagctataatacttttttctaaacagtggatttatgttgaataagtacatatacaaatatttattaataaagctcttttgaaatgagaa

SEQ ID NO: 4162 - DNA, 892 bp, Homo sapiens
ttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 4163 - DNA, 626 bp, Homo sapiens
tccagcgcccagagagacaccagagtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 4164 - DNA, 1415 bp, Homo sapiens
agtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaaggtatcccctgcccccgcctctttcccagcattttctaacatcttcctcctggtcaaaacagaaacttctggccactggttggtgcgagaaagttggctgtgatcttgggatgctatatgacttcagggaagaacctggagtgggaggattatgtcagtaaaagagacacttcccctcatccatcaacagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctccaagaacccaaagtgctgttccctaatcccactgacccttcctcagcacatctgcttgttgctctgcagctctgactattccagacaccag

SEQ ID NO: 4165 - DNA, 341 bp, Homo sapiens
gagctgggctgcagcttgggtgctggccaccaggcccgtgcactcccgtgccagatgcctgtctactcagcttggcctgcggaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgt

SEQ ID NO: 4166 - DNA, 595 bp, Homo sapiens
gtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 4167 - DNA, 1095 bp, Homo sapiens
atttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctccaagaacccaaagtgctgttccctaatccca

SEQ ID NO: 4168 - DNA, 3652 bp, Homo sapiens
agcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 4169 - DNA, 1140 bp, Homo sapiens
gcatttgaggggggacgtaattcagcccatacaccaggctgccttctcttattcccagtcaccctttccgtgctcaaccaacttgggataaacaacccaggacatcccagggtagggtcccggaacaaatcccacagggacgacagcggcctgtctattctccagtgttcgattctcctcgaagcgatgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcag

SEQ ID NO: 4170 - DNA, 4603 bp, Homo sapiens
gcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaca

SEQ ID NO: 4171 - DNA, 1446 bp, Homo sapiens
gggcagcaggcaggcggcgggcgctcagacggcttctcctcctcctcttgctcctccagctcctgctccttcgccgggaggccgcccgccgagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgag

SEQ ID NO: 4172 - DNA, 1650 bp, Homo sapiens
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgta

SEQ ID NO: 4173 - DNA, 2444 bp, Homo sapiens
attactgacacaaacgctccctcagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaataaaaaagaaaaagc

SEQ ID NO: 4174 - DNA, 1426 bp, Homo sapiens
gggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaactaagttccatgacatctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaa

SEQ ID NO: 4175 - DNA, 2264 bp, Homo sapiens
ttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 4176 - DNA, 2413 bp, Homo sapiens
cgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagaagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 4177 - DNA, 2019 bp, Homo sapiens
gcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgaggtaaagatgcctgcgtgtggcatggtgacagaagctccagcagtcgggagtcgtccacgctccccaagcagttatgaccttgtcctgcacgttcctctcactggggctgaagcctgtctgatgtctgtggaggaagagacggagctgctccttagaagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaagcggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 4178 - DNA, 680 bp, Homo sapiens
tggcactcccaaagtgctgggattacaggctggtctcgaactcctggcctgaagtgatcctccaacctcagcctcccaagtagctgggattacaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctgggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatac

SEQ ID NO: 4179 - DNA, 709 bp, Homo sapiens
agatgactgcagagtgagagtgaaaccagcttccctcggaggctgcagcacagggctgacatgcaaacgtctgaaaaagaggcaagctctcggtgtgagcaagtggactgcggctatttgaggaaggagcccacgtgggaatcccctgagctgcgccatggccagaggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcgg

SEQ ID NO: 4180 - DNA, 823 bp, Homo sapiens
accggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggca

SEQ ID NO: 4181 - DNA, 2209 bp, Homo sapiens
gtagctgggcgggcccttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 4182 - DNA, 1789 bp, Homo sapiens
gaaaccagcttccctcggaggctgcagcacagggctgacatgcaaacgtctgaaaaagaggcaagctctcggtgtgagcaagtggactgcggctatttgaggaaggagcccacgtgggaatcccctgagctgcgccatggccagaggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgct

SEQ ID NO: 4183 - DNA, 2492 bp, Homo sapiens
gggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctc

SEQ ID NO: 4184 - DNA, 2239 bp, Homo sapiens
agaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttg

SEQ ID NO: 4185 - DNA, 2459 bp, Homo sapiens
cggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaa

SEQ ID NO: 4186 - DNA, 1786 bp, Homo sapiens
agcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgct

SEQ ID NO: 4187 - DNA, 7640 bp, Homo sapiens
cgagggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 4188 - DNA, 701 bp, Homo sapiens
ccgcggcggaggacgcgcccggcgcccctgagccggccgagcggcgacggaccgcgagatggcgtctcgctctgtcacccaggctggagtgcagtggcgcgatccctgcttactgcagcttctgcctcccaggttcgagagattctcctgcctcagcctcccaagtagctgggactacagcagctgacatctgtgaagcctcagtgatcctataaattgaggaacctgagagaatcaagagaaagacaacaattcttgctgatatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagc

SEQ ID NO: 4189 - DNA, 1465 bp, Homo sapiens
gagcggagcctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 4190 - DNA, 3617 bp, Homo sapiens
gctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 4191 - DNA, 1090 bp, Homo sapiens
gctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtga

SEQ ID NO: 4192 - DNA, 2183 bp, Homo sapiens
agctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaat

SEQ ID NO: 4193 - DNA, 1204 bp, Homo sapiens
gcgctgctcttccccgcggagcccgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttcaaatcaggtcctcaaacacttgttatatcatgggaccccggaaattggagtgaagctagaaacagaaaacccatgcagggcctcggattcccacaaatgtgacaagaggtatagggagtga

SEQ ID NO: 4194 - DNA, 1264 bp, Homo sapiens
cgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggccaagttactcacccg

SEQ ID NO: 4195 - DNA, 2195 bp, Homo sapiens
gcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctact

SEQ ID NO: 4196 - DNA, 2068 bp, Homo sapiens
ccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaa

SEQ ID NO: 4197 - DNA, 2245 bp, Homo sapiens
aatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcatcttgctctgtcgcccaggctggagtgcagtggcgcaaccttggctcactgcaacctttgcctcccaggttcaagcgattctcctgcctcagcctcccaagtagctgggactacaggtgcgtgtcaccacacccagataattttttgtatttttagtagcgatagggtttcaccgtgttagccaggagggtctcgatctcctgacctcatgatccacccacctcgggctcccaaagtgctggaattacaggcatgagccactgcacccagcctttttttaattattatttgaagaatttaagattggaattaattgctccttgaatgtttggtagactcatctgtaataccatttgagcctagaatattctggtttttttgagacggagtcttgccctattgcccaggccggagtgcagtgggattacacgcgtgagccaccatgcctggccagaatattctttattgtaaaatttaaagctgtaatttcaatgtcttgaagagttatagatctaattagattttccatttctcctggagtcaatttggtacaaacagtcaataaagactacaagaccagtttaagta

SEQ ID NO: 4198 - DNA, 4844 bp, Homo sapiens
aagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaa

SEQ ID NO: 4199 - DNA, 3908 bp, Homo sapiens
tttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaacta

SEQ ID NO: 4200 - DNA, 3005 bp, Homo sapiens
tccagggaagatgtcggagcctcagatgttaattttctaattgagaatgttggcgctgtccgaacctggagacagagtatcagcgcctttgcttgctgctgtttttgctgttttttgatgctgggaaccaccacctaaagatagtaaagaaaacacaggaagctttccggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatttccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctgga

SEQ ID NO: 4201 - DNA, 3368 bp, Homo sapiens
ggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatttccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaa

SEQ ID NO: 4202 - DNA, 459 bp, Homo sapiens
ggagccaaccgtggcgcaggcggcgcggggaggcgtcccagagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattc

SEQ ID NO: 4203 - DNA, 4088 bp, Homo sapiens
aagtaagtttgtattttaccatagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatttccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaacaccatgttctgtctcactaacctccaaatggaaaataatagatctagaaaattgcaactgcccttagaggtttccagtctccattgattttctttcagatccaataataccgttctgtcctgctgtgttgattatggaatgtatcctaatcatgggaagggcaccttgggagaagttgcagatggctgacgtgctttctctagcattcagctaaaaaatgggatggtccatgattctgcgttctctgtgttctgcaaaacaacattaagtagaaaacaaacagaagcagaggcacatttccttcttttgccacagaaacaatgccactgttgagtgcaagtcacactttgtctcatagataagaggtggccccaaagaagctgggatgaatgagtcactacctgtcttgtgactgtactgcacttcatgttcttaccttcggcttctccaggtctcgccctagtgagccaagaactttctctcacatgctgcctttatttaagcctggccttcaagaccttccatgatttatcaccaacctaccttttcagctttgtttcctagcacacctcattgatcagctgctcaggctgttgcatgaagaacatggactttgcacacagatcctgggttgagttctgagtcagctgtgtattagccatgtaaccttggccttggtatgcccttgctggacctacattttctcacgtaacagcatctatgtcatagaattcctgtgaaaattaaattggccaaggatgtcagggcttctcagatcttttccttcgttgccctaatgaccacaagagaacacatacactgaaggcctcctggggggcagttgcaatttcactgaagttgtatttttttatcttaaatgaaatctatgtgtattttc

SEQ ID NO: 4204 - DNA, 5812 bp, Homo sapiens
caagtgagcccttctcatcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcagaggctggaatgcagtggcacgatctcggctcactgcaacctccgcctcctaggtttcagtgattctcttgcctcagcctcccgagtagctgagattacagacatgcaccatcacatccagctaatttttgtatttttaatagagatggggttttaccatgttggccaggctggtcttgaactcctggcctcacttgatccaccatcctcggcctcctgcgtaagccactgcacccagctatttgtgtctaattttatttatttatttttaatttttttgagacggagtttcacttttgtcacccaggctggagtgcaatgcactatatctccaacaagtagctcagtgctagcacaattttttgaatcatttttatttgtagccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaa

SEQ ID NO: 4205 - DNA, 5641 bp, Homo sapiens
caagtgagcccttctcatcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgctcatttgtattctagatttctgatagatcccttcttccctaatatgatccctaatatgaatctttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaa

SEQ ID NO: 4206 - DNA, 5809 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacaggcaataacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaaggtaattttattcttaaattatatgatttatctttacatatatgtgttcttattgtttttaatatataaagtggacttgaatattgggctagcttattttacaggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaagcaaaattgtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaa

SEQ ID NO: 4207 - DNA, 5758 bp, Homo sapiens
gattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaa

SEQ ID NO: 4208 - DNA, 5189 bp, Homo sapiens
atggccaagtcgggtggctgcggcgcgggagccggcgtgggcggcggcaacggggcactgacctgggtgactctttttgatcagaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacatt

SEQ ID NO: 4209 - DNA, 3525 bp, Homo sapiens
gtgtgtgcggtgttatgccggacaagagggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttact

SEQ ID NO: 4210 - DNA, 5389 bp, Homo sapiens
tttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactg

SEQ ID NO: 4211 - DNA, 551 bp, Homo sapiens
gtgtgtgcggtgttatgccggacaagagggaggtgaccgtggcggcggcggcggcggctctgtttattgtccctctcggtgtgtgtgtgtgaggaaatcggggctgcagcgaggctaaggctgcctttgaagcagcggcggcgaccgggacgactactctggcaacggggcactgacctgggtgactctttttgatcagaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggca

SEQ ID NO: 4212 - DNA, 1897 bp, Homo sapiens
tctgacaagatgcagtgataaaacattaattctactctcttaactttaaaatgtggtatcctctcattttgttactgagtacctgaggaaatcagttaatttttcatcagattcctggataaatagggatagtgtataccattccttctgaagatcttattgcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctg

SEQ ID NO: 4213 - DNA, 2061 bp, Homo sapiens
tgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtg

SEQ ID NO: 4214 - DNA, 3786 bp, Homo sapiens
ctggattcggtgctgaggcggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctca

SEQ ID NO: 4215 - DNA, 1581 bp, Homo sapiens
ttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtgatctaccagcctcggcctcccaaagtgctaggattaacaggcaggagccatcacacctggtctcttcccccatttttaaattgtgttgtctgtctttgttgttgagttgtaggagttcttaatagtttctggatatcagatgcctttgtggttttcacatctctgcaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatcaaa

SEQ ID NO: 4216 - DNA, 1951 bp, Homo sapiens
cagatctaagcccaagagcaagtggcggcctcaagccttggacactgtggagcttgagaagctggcttctcgaaagttgagaataaatgctaaagaaaccatgaggattgctgagaagctctacactcaaggggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcct

SEQ ID NO: 4217 - DNA, 3156 bp, Homo sapiens
tgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccaggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagt

SEQ ID NO: 4218 - DNA, 2863 bp, Homo sapiens
gccagaagcggctggacccggaaataggggttgtcggtagccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccaga

SEQ ID NO: 4219 - DNA, 3107 bp, Homo sapiens
ggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatctta

SEQ ID NO: 4220 - DNA, 2033 bp, Homo sapiens
aacaaggaccggagctggatccgcggtgcggctgtgggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggtgggtgcgcctgcccaggccccagagccggctccgtctccagtactcaggcttcgagtctactcacaaagctgccccgccagccctgtgtgcccagcccagcacccctccatgggctggtatctggaaactggtgacccagtgtgtggccagccaggcaggtccacagcgggcatcccctcctgaggcctccattcaggacctggccttccctgtgaaggcccagatgtgccctcgtgcactgtggggtgtgcacacaccgactaacgcccacaaggctgaagattggcccagatgccaggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggtagagtctgcctctggcctgcccctcaccagaggggtgtctctctgtcagcaaggccagtacct

SEQ ID NO: 4221 - DNA, 824 bp, Homo sapiens
gtagccgccccgggaacaaggaccggagctggatccgcggtgcggctgtggtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaag

SEQ ID NO: 4222 - DNA, 582 bp, Homo sapiens
agaagcggctggacccggaaataggggttgtcggtagccgccccgggaacaaggaccggagctggatccgcggtgcggctgtggctctttagggtgagatctgctgtaccagtctcacaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagg

SEQ ID NO: 4223 - DNA, 736 bp, Homo sapiens
ccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggtagggaaactgaggctcagggaagctgtgcagccaccggggcccagatcggtgcggtacacacccaggcagcttccactcgccgccccctaggccctggctgggttttgagggcacccaggttctctgacctgttatctgtaaatgaagtagggtacttttgtgaacaaattagctggaatccaggggcaataatttctcgcagaagtgaaaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctct

SEQ ID NO: 4224 - DNA, 571 bp, Homo sapiens
ataggggttgtcggtagccgccccgggaacaaggaccggagctggatccgcggtgcggctgtgggtgagtccacctgtaggtggaagagccagtccagagaggagggccaggcatccacctggcctgacccatcactccagatccccaggccccagcatcttcctagcatggatttaggaataaaattgacctgagatcactggggccacttcaccttcccccaaatggagccacattcccaggatcatctcagccacttcagctgacctggtagttttttcttgtttttaatctcagatgtcttcaagtttccctaattccctaatttttcttcttcttgcctcaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacact

SEQ ID NO: 4225 - DNA, 550 bp, Homo sapiens
aacaaggaccggagctggatccgcggtgcggctgtggatgtcttcaagtttccctaattccctaatttttcttcttcttgcctcaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggg

SEQ ID NO: 4226 - DNA, 400 bp, Homo sapiens
ttgtttttaatctcagatgtcttcaagtttccctaattccctaatttttcttcttcttgcctcaggttggtcttgttttttctttgttaaagtgattttccttgtagtggtgtaggttctattgacagcattgctatcctgagtgtcttttcttctctttaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctgg

SEQ ID NO: 4227 - DNA, 557 bp, Homo sapiens
gaaataggggttgtcggtagccgccccgggaacaaggaccggagctggatccgcggtgcggctgtggcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctccctcaggcctcagtctgcacccaggctgccccgggagtgagaccccatccctgccctcctgctgccgccagagtagctgacagggtggttccatgtggcccagtgacatga

SEQ ID NO: 4228 - DNA, 543 bp, Homo sapiens
gttgtcggtagccgccccgggaacaaggaccggagctggatccgcggtgcggctgtgggtgagtccacctgtaggtggaagagccagtccagagaggagggccaggcatccacctggcctgacccatcactccagatccccaggccccagcatcttcctagcatggatttaggaataaaattgacctgagatcactggggccacttcaccttcccccaaatggagccacattcccaggatcatctcagccacttcagctgacctggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcac

SEQ ID NO: 4229 - DNA, 561 bp, Homo sapiens
aacaaggaccggagctggatccgcggtgcggctgtggctctttagggtgagatctgctgtaccagtctcacaggtgagtccacctgtaggtggaagagccagtccagagaggagggccaggcatccacctggcctgacccatcactccagatccccaggccccagcatcttcctagcatggatttaggaataaaattgacctgagatcactggggccacttcaccttcccccaaatggagccacattcccaggatcatctcagccacttcagctgacctggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtg

SEQ ID NO: 4230 - DNA, 2956 bp, Homo sapiens
atttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggtgagtgcagccactccctcctgtccacaggtagctgcagtctcttttcagtgccaacccctgccttgcaccaggctggactctgaggggacccctcaccctggcctttcctgcactcattggcactgagacgagagaccctggatgtagctggggcactgcttaggcctcagccagtggtgccaccctctctctgtgtcagaatcgagcaggcaaccctagtccaccctcaggacctgggcacaggtgtgcagtgctccctctggagctgagtgagcaagaggatgcagcagtcgggggacccacccggtgagcgggcacccccagtcagcgtccaccaccgtcctccatcctcatcctcgtcctcattactggaggagggagcgcatgtccaggcaggcaggacagagcaccgagccagaccaggaatcagcgggagtgaggcatctgcccacattcaccgtgtgctctgcagaaagctccctcaggcctcagtctgcacccaggctgccccgggagtgagaccccatccctgccctcctgctgccgccagagtagctgacagggtggttccatgtggcccagtgacatgagggtcatgtggcattaccagtaacaagctggcagcaaagcaaaggggggatggagtcagctgaaacccactgggatggtgccagcgaggggccttgaaagttgaggaggtttcaggtaagcagaaaacaggggtaatggcagccaggagccgaaacatgagcaaggctgtccccaagagcaaggccaagaagagttccttctgctgggacgagggatccaggagcttgaggcattgggagcaggcagcagagggcaggtgggcacagtgggcgtgcctttacagggctcccttctcccgccaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatcca

SEQ ID NO: 4231 - DNA, 3121 bp, Homo sapiens
gcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttc

SEQ ID NO: 4232 - DNA, 3123 bp, Homo sapiens
gaaccgacacgaggcttcacctgggaagcttcaagtctgcctacctgtgaaaggtcaggccccaacaccccttctgggaaatcctacagctaggatgcatttctctcactgaaccccatccagcagaggacagaagagtcagaagagggtagagaggatttagatactcatagaagatgtagtggaggatgaagtgccaacctcgctcgggagccaggcgcattgaggagagacttcattacctgataactacctatctgaaatttggaaataataataactatatgaatatggctgaggcgaacaatgcgttcttcgctgccagtgagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttc

SEQ ID NO: 4233 - DNA, 6237 bp, Homo sapiens
tgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatat

SEQ ID NO: 4234 - DNA, 7410 bp, Homo sapiens
tctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttg

SEQ ID NO: 4235 - DNA, 3010 bp, Homo sapiens
cttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggagtttggtacctggagcgagagcttctccgcccttccaccaaccccacaggccgcttcgcgggtggagccctctgcctggccatggaggaaggatcccgctaggctggtcccgactggagaagctgctctgccaggtgtgctctctgtcagcaatagtgacctcattaccaaggggtggcgaccacattaccaagcgcaattccccattctccaagggctgagaacttcggtgacttcatccacctgtctatttgcacatggaggacttttcaagatgtcaggatacccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgattgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctggttctgcatccaactagctgtttcttgaaagagcctggatcctcagttttcccatctctgcaagcagggataacggtaatgagaatgataataatcattatatgcagaccttcctctttcatcttacagaggcttagtgaggctcagatgagattatatctgtaaaatcccttggtaaaggaaaagctccgtgaaaatgtcagttacttttactaagtggcgggtagtgaattatctgtgcctagacccaaactgaaagtgtctcaggcaggaagttccaagggatgtatgtttatagcatccaggcaatgatctttttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctctcctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatcctgagtccaggagtctgaagtggggccccaggtgatgtcattgctgctggtcccaggaccacattttaacaatcaatgttttcaggtgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacccgggtgtgtggacatg

SEQ ID NO: 4236 - DNA, 4551 bp, Homo sapiens
ccacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggaggtgcgagtctgggaaaggcgcgctcccggggggagcgggccccgggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgatatttggagtgatttttaaaaatatttggaataagaaagtgggaaactatggggaagcttgataatgaaaatggttcttttaaacctcaatctaaacttctagagatagaagaaaattgcatatgagtttcataatgaagatgcagattatgttttatactgaaaccttaaaaaagaaatatatcggttacttttaaggctaatagaaattatataactgaaaacaaagaatgggcagtattaaagttatccacagttatacagttcaagagtaaaacgcaccagaaaaaggaaatccaattttcatggattccaccgtatgactgctgacacgggcgagaaagtaaactccaccttttgtcaccttccaggtgtgagcatagctgcaaactagtgaagaaataatagaagctatgaaagatgtaaattccataacccttagggtgtgtttcaggattttcaaagctctgcagcatacattatctacatttcttattaatagtccattaattaattctaacaataaacccgcatgcctgccttttggttgctgttagcgggtgcgtttagctcccgccacgacttccggcggactgggtttaatttaaacattttccaggctacggaacagctcctaagggaagattaagttgagataaacagagaagcaaggccgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtcccgactggagaagctgctctgccaggtgtgctctctgtcagcaatagtgacctcattaccaaggggtggcgaccacattaccaagcgcaattccccattctccaagggctgagaacttcggtgacttcatccacctgtctatttgcacatggaggacttttcaagatgtcaggatacccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgattgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctggttctgcatccaactagctgtttcttgaaagagcctggatcctcagttttcccatctctgcaagcagggataacggtaatgagaatgataataatcattatatgcagaccttcctctttcatcttacagaggcttagtgaggctcagatgagattatatctgtaaaatcccttggtaaaggaaaagctccgtgaaaatgtcagttacttttactaagtggcgggtagtgaattatctgtgcctagacccaaactgaaagtgtctcaggcaggaagttccaagggatgtatgtttatagcatccaggcaatgatctttttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctctcctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatcctgagtccaggagtctgaagtggggccccaggtgatgtcattgctgctggtcccaggaccacattttaacaatcaatgttttcaggtgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacccgggtgtgtggacatg

SEQ ID NO: 4237 - DNA, 4445 bp, Homo sapiens
gcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacg

SEQ ID NO: 4238 - DNA, 4436 bp, Homo sapiens
gcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacg

SEQ ID NO: 4239 - DNA, 2463 bp, Homo sapiens
ctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccaggtgccaacccacccctcggcactccccaccctcaccccatcaggacgcacatgtgcacaggccacacgcacaccgcacccacactgggaggccgtcggcgggccccacgctcttcccccaacctcactgtctccctctggccccctcccggcgccctccccatagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctg

SEQ ID NO: 4240 - DNA, 4074 bp, Homo sapiens
ggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacg

SEQ ID NO: 4241 - DNA, 1177 bp, Homo sapiens
cagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggac

SEQ ID NO: 4242 - DNA, 8332 bp, Homo sapiens
gtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcattt

SEQ ID NO: 4243 - DNA, 8317 bp, Homo sapiens
gtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagca

SEQ ID NO: 4244 - DNA, 2478 bp, Homo sapiens
gtctacagtatcacctttcttgtagattggcacttatgcggccaaaggaacaacaccatgttttctaaaaggctggagaaaatagcacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagcaaatgttttgtaaacaccaatctaagaacattatctcttggacgggcatggtggctcacacctgtaatcccagcactttgggaggccaaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaaccccca

SEQ ID NO: 4245 - DNA, 7240 bp, Homo sapiens
atgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcattt

SEQ ID NO: 4246 - DNA, 2745 bp, Homo sapiens
cttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagccc

SEQ ID NO: 4247 - DNA, 1914 bp, Homo sapiens
gtgtgagtctgtctgtgtatgtgcagaacacagaccctcctttctccgtttgtggggaatacttccctcgggtgaaactgaagttaatttttttttttttccaaacacaagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatc

SEQ ID NO: 4248 - DNA, 2572 bp, Homo sapiens
cttttggagaaatggctttcggaagttttgccaggaaacgtagccctaggcaggcagctttgcagccccctttctgcttgttgcactttctccattcgttcctttgctttttgcaggctctgactcagggaaggtgtgcattatccactagatacgtcgaagaagagggaaaccaattagggtcgaaataaatgctggagagagagggagtgaaagagagagtgagagtgagagagagagagagtcttgcttcaaattgctctcctgttagagacgaaatgagaatttagtgcagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttg

SEQ ID NO: 4249 - DNA, 2396 bp, Homo sapiens
attaactcatgttctgtttccatggagcacaggagagtaacaaggaaggccccttaaaagaaaggccttttaaagtggaggtctcagttcacaaactttaaaagtttacgaagtagtattttagaattttaatcaccagatatattgggggaatttattacttcctattcatatggaagaggacagcagagatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttgg

SEQ ID NO: 4250 - DNA, 2255 bp, Homo sapiens
gactcagaattttgaatagtttctttgctaaattcaccatctggagagcctgtgattgattagttttggcctcactattaagtgtcaatataatcaatgggaattactaggctagggtcattacatagataatttgcctgctgtgtaaataaaaatgaaattgtttaaattttgtgcaagagaaagtgaaaataaggagttacgatttgtttgttagagaaagtggaggccattggaatgacagtttttggaagtgtggagcagtttggctaagaataggaatgaaggatatttttttccagtttatcatagccagagtgaggaagtgttattccctctcttgcttgcatacattgccagtagtgcctactttacgtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatc

SEQ ID NO: 4251 - DNA, 2367 bp, Homo sapiens
cgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaa

SEQ ID NO: 4252 - DNA, 866 bp, Homo sapiens
gtcagagttaccggtcagccgggcgggcgccgccggggtctggggtggacgccgcgagcctgcacgttgcgccgggaccccggggctgtgcccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacct

SEQ ID NO: 4253 - DNA, 792 bp, Homo sapiens
aggtgggtggtggggcacccccctgcagcggcgggagggaggcgctgcgccctggctcctggggctcggccccaccctcggccgctgggcgggccgtcggggacctgggggtagtggtggtgaccctgcgggcccgcgggccacttttccgcagggggcatttccgtctggcgaggcgactgaaaatcctgagtgtgggagtcggtttggccagctccgctctcaggatggagggtgcctttgggaaggaagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagt

SEQ ID NO: 4254 - DNA, 1327 bp, Homo sapiens
gcgcacgtcacgccggcccgacgctcggccaggaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatg

SEQ ID NO: 4255 - DNA, 1571 bp, Homo sapiens
gtgcggaggcggcccgaggcctagtgacaggcgcgcggcgcggaccccggaagcccacctgtcagagttaccggtcagccgggcgggcgccgccggggtctggggtggacgccgcgagcctgcacgttgcgccgggaccccggggctgtgcccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagagaagacaggcttatgtgactgcacagcgggatgtcctgctccgtggcgcagtgtggaaaatactggacaagcgaaggatatccggaagcttctacagccgtctgtcctgtggaactgcgcgtcattttgttggttgcctgtgcgtcttgtgttgtttctgtttcatgaccattcgcttattttctttcccttttcagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcg

SEQ ID NO: 4256 - DNA, 1276 bp, Homo sapiens
catttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttc

SEQ ID NO: 4257 - DNA, 1732 bp, Homo sapiens
gcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaaatacctagaagtggaattgctgggtcatatggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtg

SEQ ID NO: 4258 - DNA, 1267 bp, Homo sapiens
atgcaaccagaaggcatcatctttgaagcagagaataaaccctcaccaggcactgaatctgccggcactttcattttggacctctcagcaacctccagaacaattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagaga

SEQ ID NO: 4259 - DNA, 1853 bp, Homo sapiens
gctccgccgccaaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaaatacctagaagtggaattgctgggtcatatggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtga

SEQ ID NO: 4260 - DNA, 571 bp, Homo sapiens
ttctggcttttaaaaaaactgtgttgtttctgtaataaaatctgggaatgtgtagtcccagctactcgggaggctgaggcaggagaatcgcttgaatccgggaggcggaggttgcagtgagccaagatcgtgccacttcactccagcctggtgacagagagagactacatctcaaaaaaaaaaaaaaaagaaaagaaaaaaattctgggaaccccatgactggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcacc

SEQ ID NO: 4261 - DNA, 578 bp, Homo sapiens
aaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgg

SEQ ID NO: 4262 - DNA, 1201 bp, Homo sapiens
caataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagccta

SEQ ID NO: 4263 - DNA, 416 bp, Homo sapiens
ctgtaatcccagcactttggggggccaaggtgggcggatcacctgaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgt

SEQ ID NO: 4264 - DNA, 3138 bp, Homo sapiens
aaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatca

SEQ ID NO: 4265 - DNA, 578 bp, Homo sapiens
gaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatgg

SEQ ID NO: 4266 - DNA, 1442 bp, Homo sapiens
actgaatggtaacaaagactgtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatg

SEQ ID NO: 4267 - DNA, 878 bp, Homo sapiens
gaaactcgtggtgcttttgctctgctttcaagatgcattaagtctcctgctttgtgactgctttggagccagcagatactctgatatgtataattcaaattatgcaggtttcacgagcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaa

SEQ ID NO: 4268 - DNA, 9911 bp, Homo sapiens
gcgcactgtgctgctccgccgccaaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaaggattattgaataaaatttttctgaattaaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatcatgtggatttgtcccaagattatgctagatgcaccaagcatggcccaaattggttcttttttaaatcccatgggggaagtgcaggctccttcctgtggtgcctctttatagcctcaccaccatgctaacactgagcatggtgaggaggaggaagctttggctagctaaacatgtttaataaggccataaaaactgagaaagaaaaacattcaactttagctgaagctcctttgatacaaaagtttcattctgtcagaaataagccatagtacagactcagagatagaggcagtttctagagaactcggtcttatcgtgggttctggagcacacctctcagaccagtcaggaacactggggaggtgacagcaggtccccaggggcctgcagggaatctttcagctgcacggattgggatttccctccaaaccaaactgtcctttaaggggcagcctcctcttttactaactccaccctttctcatctctgggacccagcagggacctggagaggccaacagccactgctacctttgtagtcttcaaaatattgaactgcaggtcccaagatgcatttcaggatttaagacaggtgcactaatgataaccattccttcaccaagtagcaacattcttgccagagttcttgggaaacctgtttttttctctactctccatctctgctgctctcatgctttaaattgataaaatatgggctcaaaaaaagaaagccgccaaagactcttatccttattggtgccccatcattggccaccccagccataggtgtgtgctgttggtgggaaatggtctccttcctcagcgttgtgtttgggttactggtgaggccagctcacagagtgacatcatggtcaccagtacatgtcgctggagtaaaatcttgcctttagaaactaggttgagctgttcagaaaggtcaattctcttctgtattccccctcaacatttatctgggtctaaagctcagcactgagtcacaatttcacacaagatcaaagtgaggcagtgttaggaaaccatgggctgggtgcagtgcctctcgcctgtaatcgtagcactttgggaggccgaggcgggcacattgcttgagctcaggagttcaagaccagcctgggcaacatgacaaaaccctgtctctacaaaaatacaaaaattagctgggtgtggtggggcatgcctgtagtcctggctactcaagaggctgaggtgggaggattgcttgagcgcaggaggcggaggttgtagagccaagatcacaccactgcactccagcctgggtgacagagcaagaccctgtctcaaaaaaaaaaaaaaaaaaaatggaagttgtggtcacaatgcccaggcttctttgttatagtggcacgctgggttacttgccacacacagatcactcctcccagggctgctggcacacactgattgtggggagttcaagaggccttttccccttgagggtgtggctgtccccctttcaggcgtgtggcgtcattcatggaggaagtgctggctctacttagcacacgcacagtggcactaggacctgcgtgcctggccctcagtgggtagggcggtgctgcctaggcacacagcagcgcttacgggccccaggtgcctactaggctgccttcctcttccccgctgtcagtctgtgtcctccacgtgcttatttcctgtggtgagagcagttgtggtgtttgtataccttgtgccttatgatcaaggtgggccttggaggagggcgggaaaggagcgaccaacatggcggtcctccacccctcagcgacacccaccgcccgagaaactacagacaatggccacaagtttggcgtccttcaatttaattctttaaagaagtgctgggaagaaaaagctatgtggtttctaccattttagcaggataaagaggataactccttccattagcaaattttacagttgttaacagtactctgccatatttgaaaaataatgccagagtcagtccttgaaaacaaggtagctcctatcagaattcaaatggaaattttttttttttttttttttttttttgagactgagtctcgctctgttgcccaggctggagtgcagtggtgatctcggctcactgcaagctccgcctcccgggttcacgccattctcctgcctcagctgggaccatgcctggctaattttttttgtatttttagtagagacggggtttcaccgtgttagccaggatggtctcgatctcctgaccttatgatccacccctctcggcctcccaaagtgctgggattacaggcgtgagccaccgcacccggcctcaaatggaaatatttcacagaggagtggttcagtttagccctgcaagacatctataacttgactgtttgctaaaccacaactctttttggctacttgggtcatagagacagcagagttgctccaagtataaatgtgacttaggctccctccagcacacagtgtgtatgttggagggagtgtggattagcagagaatgagaactacctcagctattcctgccataaccacactgagagaggggggcacggtggggagcctatttagcttttttttttttttgagacggagtcttgctctgtcgccaggctggagtgtagtggcgcaatcccggctcactgcaacctctgcctcccgggttcaagcgattctcctgcctcagcctcccaagtagctgggattataggcgcatgccgccacacccgactaattttttgtatttttagtagagtcagggtttcaccgtgttgcccaggctggtgtcgaactcctgacctcaggtgatctgcccacctcagcctcccgaagtgctgggattacaggtgtgagccaccgcacccggctctatttagctttttaaaaattatttcctttcaagggccctttaatatctatcaagctccctcccctaacaaaatgggctgtccctgcccaacaagtctgaaatagaccttaaaactgtgctgccttagtggtaagtaaggggtgggggttggacagtgaatcttaagatttcatccttcattcagtaagcatttgagtacctactgtgagcaggcattggggcggagcagcgagagccctgccgatgttgggttctcctcctattggggaaacttgatcacagatggaacacgtgcagattgattgatgagtgctgtggagaaagcagcagcgtagcgggaccgtttgggaaaggctactttggctgggggtggctgggaaaggcccctctgggaaagagacagttttactgagtcagatggtggaaagacagatgtctctatactttcttaacaagccactctgtcccataacatgcacttggaatctctcctaagttccagaggccccactgttccagtttcaagccttcattttggagtctgtttgggaacttttaagacttcaaagcaaagttagctaccagcaatttctgtaaaccaagagaagattgtcacaaagattcactactttccaactgaatctatgcagtagaaaaatcattagaaaatacaaaaattagccgggcgtggtggcacatgcctgtagtcccagctactcgggaggctgaggcaggagaatcacttgaacccaggaggcggaggttgcagtgagccaagatcccgccactgcactccagcccaggtgacagagcaggactctgtctcaaaaaaagaaaaaagaaagaaagaaaaatgattagaaattgagaactattttacgtgtttctaagttgttggctacatcaaagagatcatctgtattctgcatatgggctggctttggtgaagctgatgactggacttctaagaaccgttttcccaaatgggttcccatattcatgcacccaaagcaatggtccccaagcactgatgaaaactaatatgcatttcccaaagacccacactatgtatcaggagcctgcaccatgccatttgaatgaccctcagcaatgtgcctccctgccctcaaattcccagttgataacagtgtttgattaaatttccactcaagccaaacatggttactaagaagagaaaaacctgatgtttgcataatattttttttcccctcgagatggagtcttgctctgttgcccaggctggagtgcagtggcatgatctcagccactgcaacctctgcctcccgggttcaagcgattcttctgcctcagcctcccaagtagttgggattacagacatgtgccaccacgcctggctaatttttgtatttttagtagagacagggtttcaccatgttgaccacactggtcttgaacttctaaccatgtgatctgcctgcctcggcctcccaaagtgctgggattacaggcttgagccaccacgcccagcctaagattttatgattaaaaaaaattcaagctcaatacccacataaattataacgtttctcaggaagtagtcccttaaccaaaacgtctctgagaagtgatgcttaggtaatctctgggatccgattttcccacatgtctcactccacagtatgctaaagaagaaaaagtgagtgggcacaacactttgaccctctggctaagccctgggagtccctgacaggtccagaaacttctctgacacccattcaccagggtgctgagataggagaaagtgctcatttataatgtgtattctgtgcagctgttctcagacaagaccggatcttgtcatcttaccttttgctttacaaaaaaggcctgttgaagtcaatgctgtcttgccccttgctgtttcagcaggttagactttggtcttcactgcttatagctgcattggaggccaacgtagctgatgctcagggtcaggcctcgccccttcgccgcaggtctcaggatcggggataacatcgctcccaccctgctcatttagagatgggaaacaagcaagagcttgacttgcctcccatccctcagcctgtctgtggcagagcctgcaccaaaacccagagcttcttccctccgtgagggccacgctgtcaccacagtcctcccagatgggttttggattagcatcagtcctgtgtcaccaagtgccaaacagctgaggggtagaagtgggactcctttcccgagccccagcatgaggctgtggtgtcaggtttaggcctctctcaagtcagaaaaccccgggctgagacctccacagacaagggctccccatgctggccattggcaggggcccaagaagttcagtgaccaactggtccttccacaccacaccagctggtgctgcccatgtctgtcgaatcataacggaaaattccccagatcacgtttggatttaaaaactcatcccttgtcgtgcttcaatgcatgccatttgtcacttaccatacttcaccatggccgagcttcatgtcacatggcctggcgattgtgcttgttcacactggggccaggattttcatactaaaacgtcactgacaatggggctacttttctcctgaatagctcctctgggcttgttgcagttctagttttcccagtagttccatggcaggttcaacctctcagtgtcctgaaaaatggaaccacccactaaccatatgcactggctgcccaggtggctgcactccggggatcacgtttcagtactgagttccttcacgcacttggttcaccaccatcactcttgagttttggacaaaagaggtgggtatgccaggcacagtggctcacgcctgtgatcccagcactttgggaggccgaggcgggcggatcacctgaggtcgggagttcgaaaccagcctgaccaacatggagaaaccctgtctctactaaaaatataaaattagccgggtgtggtggcgcatgcctgtaatcccagctactcgggaggctgaggcaggagaatctcttgaacccaggaggcaaaagttgcaatgagctgagatcgtgccatttgcactccagcctgggcaacaagagcgaaattccatctcaaaaaaaaaaggtgggtaaagggccatgagcccaaaccactaggttgttcaccttttcatctgaaaatgctttactctgactatgtgctattgggttttatttccagaaaatatagttctccttttttctgcatgaaggatacatcgtggtgccacatgctttaagcaatttaaacaagagagataagaggaaaatgcaaccaccacatctgacttgcccaatgtagactttcctttattagattgaagtacacaacctaatatgatatattattttgtagtatctcagactttgtaaataaatgccattatttttatatggaaattttatagaagagctatttctgtatacgtaattactcctgattttctgaaattgcttctggtagataacagacaagtcctaagcagtgttccactaagggtggttccaggcctgcctgccgtggagttgactgggggaattttacagttttgcgatcctaggatgcgtcccagacgctcagtcagaagtgctggaggtggggcctgggaagctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacacttt

SEQ ID NO: 4269 - DNA, 1403 bp, Homo sapiens
gtagaatgttgttggtactgcagtgagaggcatgcttccttagaccagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacg

SEQ ID NO: 4270 - DNA, 1773 bp, Homo sapiens
ggggccggatccccggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 4271 - DNA, 1803 bp, Homo sapiens
ggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 4272 - DNA, 1886 bp, Homo sapiens
cggcttccttacatggtcacggccgggcttccagctcccggacgtcccccgccccccgcccccaccggacacggcccccgccctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 4273 - DNA, 1483 bp, Homo sapiens
gccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtc

SEQ ID NO: 4274 - DNA, 4004 bp, Homo sapiens
cggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagttctgaagaaaacatgcaagaaaaagaaaatggcgggaggtgctcgcaagctggttcagcccattgccctggatccctcaggacggcctgtgttccccatcggactagggggtctaacagtatatagcctgggggagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaacactctaaatctatattctattatttacataagaaaattattttggtaaagtaagtaagtcaaaaacacagattacaaaataatatgta

SEQ ID NO: 4275 - DNA, 5720 bp, Homo sapiens
gcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaa

SEQ ID NO: 4276 - DNA, 6516 bp, Homo sapiens
aaagggccggagcgaggccgccgcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaa

SEQ ID NO: 4277 - DNA, 1653 bp, Homo sapiens
aaagggccggagcgaggccgccgcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaatt

SEQ ID NO: 4278 - DNA, 1491 bp, Homo sapiens
atggaggcggcggtcgctgctccgcgtccccggctgctcctcgcttccacgtcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaatt

SEQ ID NO: 4279 - DNA, 1538 bp, Homo sapiens
agattgacagaaatgactaatacaggtatctggcctcaaggagtttacagtttcataggagaaagaaaaacaaaactagcaattctgcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttca

SEQ ID NO: 4280 - DNA, 1002 bp, Homo sapiens
ctccctgccctggccaaggaggaggctgaaagagcctgagctgtgccctctccattccactgctgtggcagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaaccaagagatatatctgtgcacatggcttttagccatgaggcttggaaactggacaccactgtaaagaacatctagtgtcccgtaaatccataccaaagctctgaatccacaaaccaggctctggcccaaccctgcaaacacactccattgctccatcttcagtaaaggaagacaaattcatttttctaataactgtggacctgcagcccccttagatgtgttgagagtctttggaaatattttcctctgaggtctgtccacagcttccctgggcctgcgctcagctggcccgagaaggaccaaggtccctcacatttgcatgtaaacagggagtgccctctgcccttccagtgagccctgccagcgtgggggaggcttcagctctgtgatccgttccagctcactctgaattacactcctacatgcccagtcacagactttttgcaatttcattttatttcactggcccaacatcattgttaaaataaaatttagctgtgttccaaatgctgcaatataca

SEQ ID NO: 4281 - DNA, 5514 bp, Homo sapiens
gccctggccaaggaggaggctgaaagagcctgagctgtgccctctccattccactgctgtggcaggttctagaagatttctgaggactcagcagtaacttgcagtgctggactgaggctatttccttatatcaactttttgaaaactcatgggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaa

SEQ ID NO: 4282 - DNA, 5284 bp, Homo sapiens
atcaagacatcaaaaaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctctt

SEQ ID NO: 4283 - DNA, 5687 bp, Homo sapiens
ggaggctgaaagagcctgagctgtgccctctccattccactgctgtggcagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattgtgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 4284 - DNA, 5715 bp, Homo sapiens
ctaaatctcttccctctaaaccttttggggatggagggattaagcctgattacagatgttgggggtggtagcaggagtcgggcaggaggggccaccaaaagccagcacatgctcctcctaggctgaaccagcctccggccggcctcgccccaggatctcggccccctcgcccagtgcgtggggctgccgccgagtgtggggctgccgccgagtgtgtggctccgctcctgcccacccagggagggcagcccctgtgccactggcctggccacccgagggagtcagcagggtggctcacaggctcactgagagagatgagctccttcaagcggggctcgctcaagagctccacatcagggtcgcagaagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctctt

SEQ ID NO: 4285 - DNA, 4282 bp, Homo sapiens
ctccttcaagcggggctcgctcaagagctccacatcagggtcgcagaagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 4286 - DNA, 4584 bp, Homo sapiens
atgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaaaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctag

SEQ ID NO: 4287 - DNA, 3205 bp, Homo sapiens
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaa

SEQ ID NO: 4288 - DNA, 3240 bp, Homo sapiens
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagt

SEQ ID NO: 4289 - DNA, 1901 bp, Homo sapiens
agcccaccagaggcaaaaagaggacagtctcacggtccccaagcccagagaccactgggaggggagcaagtggggtctggaccaccgaccttagcttcacctcaacccccaagaacacctgccccgttggaggcagactggagctggctgtggattttatttctcaggagaaggaggtgggagctggagagagtgacccgtgcatctttccagcttttccttggccacctgggtggcatgggagctgggagtcagagttctgctgagctgtaggaccaaaggccactggctccgctgcacctgcggactgagacacccacctgctgagtgagacccagcctctgcgtgcttaggggtcccctgctacagggcattgaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 4290 - DNA, 454 bp, Homo sapiens
ctggctcctgagctgctgctgtgaagggaggacctggtgggctaggtaaccgggagctcccccagaaagtcactggaggttgctcaggacttccccacctttactgagtgcttttgaagaagtaggacctgccctgctccgctacagaactactggacaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaa

SEQ ID NO: 4291 - DNA, 1701 bp, Homo sapiens
gtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggc

SEQ ID NO: 4292 - DNA, 4208 bp, Homo sapiens
agtgcatcggccccgggtctgtccgggcgttgcgggattggggcctgggaacgctcggcccccggcagccgagaagcccgtgactgggctgagcagcaccatcccagccctggggcctgctgactgcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaa

SEQ ID NO: 4293 - DNA, 3099 bp, Homo sapiens
agtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaa

SEQ ID NO: 4294 - DNA, 3480 bp, Homo sapiens
gggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 4295 - DNA, 3346 bp, Homo sapiens
tgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctg

SEQ ID NO: 4296 - DNA, 2058 bp, Homo sapiens
atgctgccggagcagctctacttcctgcagagccccccggaggaggagcccgaataccaccccgacgcctcagcccaagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcac

SEQ ID NO: 4297 - DNA, 2611 bp, Homo sapiens
cggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcccgggagccgcgcgtccaaccagcccccgggtggtggcggcggcagcggcggggactgtcccggcggcaaaggcaagagcatcaactgctcagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactata

SEQ ID NO: 4298 - DNA, 1054 bp, Homo sapiens
gccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggca

SEQ ID NO: 4299 - DNA, 1109 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggca

SEQ ID NO: 4300 - DNA, 3151 bp, Homo sapiens
gggcgcgagctcagggcgcctccggggtcctcactgcgctccccacgcgctgtgaccccatttgttgcacgtgcatgttcaggtcgagagagggatgcgacgtgttcggggagcagcccaccttgtgggtggccaatccgggacgggaatcttaaacttttaactcttggtgcaaagactgatccactggcggctttacgggagcgggaaaaaaatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcg

SEQ ID NO: 4301 - DNA, 3090 bp, Homo sapiens
gggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 4302 - DNA, 973 bp, Homo sapiens
gggatgcgacgtgttcggggagcagcccaccttgtgggtggccaatccgggacgggaatcttaaacttttaactcttggtgcaaagactgatccactggcggctttacgggagcgggaaaaaagtatgtgaagcttgccacggtctcgagaccgaggtcacacgttagcagcctgccggctacatttggaccatagacgcagagtgtttgcccccaaaactggaggacctccagaatgagattcttggcgtgcaccaggccttttcgctcattcagccggcgttcctacccaggcactgcatcgaccctacacttgaggacagcttttgggtcaggggaattggtgcctggagtgagactgctctctgctttcaaggctccagctgtatccctacattgctcaggcaattcctctctctaggtctcagcttcttcatctgcaagatgaaagatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaa

SEQ ID NO: 4303 - DNA, 1214 bp, Homo sapiens
aaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggtagggctgagcccaagggcgggaggcaccgggcctgccaggttctctgcatcatcatgggacagggttcagagccgctggactgcctggcagggcttgcgcacgtttgagagcacggtgctcccgtttccatcccagctgcagtcctcatcctcttgactgtggcttctttccctccacatcctccatgtcgtgtgggtgaggccggtactgctgtctgttctctttactctgtctgcttctgcaagcagttggcttaccgggggccatagatctctcttcatttcagtccctgatacataagacag

SEQ ID NO: 4304 - DNA, 2077 bp, Homo sapiens
gtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacaaaatctgaagagttctgcgtctgaatttgaaattggactttataaagcctagaaaacagaggaggcggtgccctgcccttgtcagttgttgttctctttggtggtgatggtaaccagctgcttggcagccttggcgatgtcgtacgcacactggatgacctgctgcgtgaccagctgaacgtctgtggtggtttccaaatctgtgtcttcgtctgatgccacgctgtcatagtcgggctgatcgttgtcttgactctcaacgctgtgctggttattgatggttttcagtatgagctccacattgtctatcaataaaagcaaacaactttacttcaggctt

SEQ ID NO: 4305 - DNA, 15958 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagc

SEQ ID NO: 4306 - DNA, 17930 bp, Homo sapiens
gagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaa

SEQ ID NO: 4307 - DNA, 17949 bp, Homo sapiens
agagacagagagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagaggataaaaagaaaaaagaagccactcagaagcactccaatcaaaagacagcaatgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagc

SEQ ID NO: 4308 - DNA, 3444 bp, Homo sapiens
cggcccgcggaggcgcgtccgcccctggctggcggtggcagagggaggcgtcaggcctcggatcctcgggtccctgcgcagcgtcccggcctgtgtgcaggacctgcgtgacaagggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaa

SEQ ID NO: 4309 - DNA, 415 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaaca

SEQ ID NO: 4310 - DNA, 18279 bp, Homo sapiens
agagacagagagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagctgactttgcctttctccaatcaagatgggtgccttggggatgaggctccctgctctcccttctccccttctcccagctacaagctgtctccctctggttccacactacccaacgtcagccttggagcaatcggcacagggctcaacccccaaaacttcgctgctagacaaggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagc

SEQ ID NO: 4311 - DNA, 8410 bp, Homo sapiens
gacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacaggtaatggctcagaggcaacaggtgcaacggaggccagcacctgtgggtttaccaaaccctagaatgcaggggcccatccagcaaccttccatctctcatcagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcatataccctactgggcattaaatataagttcctctgaaagggactcgtttttgtggttttcatctgtctataatttggaatgaaaatgtgttgtaggattttgggagcaggcagctggggggaattaatagtgattttttttttttcctgaagcatctatctcatgtttttcttttgagagtcagaacatcaaacttaatctttgatctgacttctgattttattcttctgattgattgatagaggtacaaaagacttatcttctgaggacaagcatattcttaatgtgccagacctacccggttcagctgatatagatagatagatagatagaagaaaattgctgtgccatacattaatccagcatttgacacaatatctaaatggtttgccgaagttaatctgtatttataaaacattaactggagtaaatttttctccttaggatgatagaataaaaagagctcacttgaaagaaggctattatttgcattatatcacctgccataaatttaacatagaagacttggttttatctacatggctttacttcttaaagtggaaaatatcctgtggctaattcattgggttttcaggtactgctaaagataaaatacagggagaaaataacttgttagcaatagatccccattgtttatatatataggtcttgttcataatatgtcaattatgtattgttaaaaagtcctactcacttttcaaatatgtgttacatggtaatgtttgtcattgttgttttaaagttgcatttgacatttgttctccaaagagtgtttgaacagattttgataacagtgcatacaccttttgtctttttttgctccagcattttatttttagcacagcagctgtggagcttttgctgataattttattgttggtatcttagaatactgttcgtctgacagtttattcttccatacttgtctcccaagttaaaacagagcaaaacagataaattattttgagaatcatcacaaaagggagttagaacttgtgagactaaaactataatttcctaaatgtgactaatgaaccccaaactgtcactattacattcagtgccatatttatctttcaaaacagtatttgtttcaccctaaccatctttggctgaatgaaaggcagttgagaaccatcttttggtcatacataatataattatattaaaagtaaagatcggggctgggcgcagtggctcacacctgcaatcccaccagcactttgggaggccaaggtgggcggatcacaaagtcaagagttcgagatcagcctggccaacattgtgaaaccccgcctctacaaaaaatacaaaaattagccggacatggtggcgtgcaactgtaatcccaactactcaggaggctgagacaggagaatcacttgaacgcaggaggcagaagttgcagtgagccaagatctcaccattgcactccagcctgagtgacagagactcagtctcaaaaacaaaaagtaaaggtcttgggtttctctctgtaaatagcctttgtgtaatggtctttagattaatatcctttgactttattaataagtacctgtgtgcccaggtggatctcagctaagtcatccttaaattctgttcaaatagaaataaaccataaaatgagcctaactataacccacactcacttatcaagcattcccccaaaagttcagtgcgattcaggtaaccttgacctaaacttgtacactccggtgtacatctttgaccataaactctgggagatttccctctggatttgggatcaggagcccagtagggccccattgctgaatgtttatcacacttctggctagggcttatggatgagcagaccacgtaggagctaggatttactcagttccacctcactgacagcttttctaggtgccaagcaactgacttttcctgtgtaaggaagcccaagtacttgaccagtgatatatatggccatggcaaaagtataaatggatggatgtagaccatattcaacgcagaatacattttagatcggtatctggcattgtaatcattttgtcttttgaattaacatgccctgcttgtcttttctgaatggaagggtaggaaagtggaaggtactaaaaaggaaaatgtagttttagtttcttttctaagctaaagaactggctttactactgctatattttactaccacatagtagtgtagatgtagtataacttgcttaggaatgctttcaaaaaggttacctccatagtcaaaaaaagggggagtatacagctgattgttgcatttatgaaactgcatttcaatatgctatgctgttactgtgcttagacacttccttacgtttgagttccaaggagagagagtgagaagaggaactccttttgctgagctctggtccaaattaatgtgaatccccaaagtaaattgctgcatatgaacaacaggttttaggtttaaattgaagatacattcattttatatgtatttgttgtgaatgagagaaattgagtgatctgattggccattaaaattatggtgaatgggtcgggcgcagtggctcacgcctgtaatcccagcactttgggaggccgaggtgggtagatacctgaggtcaggagtttgagaccagcctgaccaacatggtgaaaccccatctctactaaaaataccaaaatcaccagggtgtggtggcccatgcctgtaatcctagctactcgggaggctgaggcaggagaatcggcttgaacccaggaggcagaggttgcagtgagctgagatcgcaccactgtagtccagcctgggtgtcagagcaagactctgtcacaaaaagaaaaattatggggaatggccgggcgcggtggctcacacctgtaatcccagcactttgggaggccgaggtgggtggatcacctgaagtcaggagctcaagaccagcctggccaacatggtgaaaccccacctcaacagaatatacaaaaaaattagctgggtgtggtggcgggtgcctgtaatctcagctactttgggatgctgaggcaggagaatagcttgaacccaggaggtggaggttgcagtgagtcgagattgcaccattgcactccagcctgggcaacaagagcaaaactctgtctcaaaaaaaaaaaaaaatggtgaccatgcgttcaaccatataatttcttactgaaattgagctcctccttttgaataaccatgtacatatttttaaaagtattttatagccctatgtaaattaatagttgatgtctttttataaatgtttattgcatattcatcttgaatgtgaatttactgttgtaattcacatactggtgtcatgtttctgagtgagaataatgctagtcagtcagatcacagatttttctccatgaaggttttacttattgagagggacatctgaggcagtagtcttcgtctttaatttttgggggcagattggtgctttggttttaataaaaactaactttgatggatttttactgtcaatattttaccacaaggattttttaatagaaaaattactgaatgttacttcagcagagttctatctactttgagtctccattactactactgttgttcccctagctgtaacattgatccatataggggcaagctactagtccataaatagctgtaataggaaaacagttttttaaaattctaacacgtgtatttcaccagccttaaaagatttaaaaaaaaatctgacaggaaggaaagcgggtggtaagtatcttggattattctgcctcataccagccactcccaaagtaggaggaccaaagatgccatgaagacttctagttgtctggaagttatttggggaaggggggaaagacacagagtggggacctttggaagtcattttaaaaatttagctatgttaattccacttgtaaagtttgaaaggttttgattcttgtaatttctgagaattactatgttttaaatttactattggatatttaacagatctttcatggggccaacctatttgcttccttaattttcaaattaagtcctaatttgagtcctaaaaaaatctttccttgttagttgcaagttaaacatttaataaaattattttcccacgttt

SEQ ID NO: 4312 - DNA, 1650 bp, Homo sapiens
atggagggcccgcgctctgcggcgtgtcgcgctcggccagcaacttccccgggcgctgtggacttgaccgcgccgccgccgccgccgctgctccgcattctcaacagccgggcggcccctgccactcgcacttttgcagacctctgtcggagtctcctgcagccggaatctcgggttctttgccggctgcagccagttaactgctacccgcccgctgcctccacaaagctttgtccagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactacccaaaatataaatacagcagcgtgcactgtatttgatgtgagggttcttcatcatataccctactgggcattaaatataagttcctctgaaagggactcgtttttgtggttttcatctgtctataatttggaatga

SEQ ID NO: 4313 - DNA, 3799 bp, Homo sapiens
ccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaac

SEQ ID NO: 4314 - DNA, 3417 bp, Homo sapiens
actcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacaggtaatggctcagaggcaacaggtgcaacggaggccagcacctgtgggtttaccaaaccctagaatgcaggggcccatccagcaaccttccatctctcatcagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcact

SEQ ID NO: 4315 - DNA, 3530 bp, Homo sapiens
ggtggtggaatatagagctcatgtgatccgtcacatgacagcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacaggccttggccccccatgtggactttgtggggggactgcaccgttttcccccaacatcatccctgaggcaacgtcctgagccgcaggtgacagggactgtaggcctgcatctgggggtaaccccctctgtgatccgtaagcgatacaacttgacctcacaagacgtgggctctggcaccagcaataacagccaagcctgtgcccagttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacagtggggccgggtgttggtctgtctctggaagacaccagttccgccctaccttccctgcctccagcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacgtagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaa

SEQ ID NO: 4316 - DNA, 1527 bp, Homo sapiens
agcagatccgcggaagggcagaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccctccacacggtgcaaaaatggctcttggcagccggagcccagaagtgccattctgtgatcacacaggactttctgacttgctggctgagcatccgacaagcagagctgctgctccctggggctgagtttcatcactatgtgggaggacctacggaaacccatgttgtaaggtccccacatccctaccagcttccacatatcttggaggtcccctatgtcaccacagtgggaggcacatccttccaggaacctttcctcatcacaaatgaaattgttgactatatcagtggtggtggcttcagcaatgtgttcccacggccttcataccaggaggaagctgtaacgaagttcctgagctctagcccccacctgccaccatccagttacttcaatgccagtggccgtgcctacccagatgtggctgcactttctgatggctactgggtggtcagcaacagagtgcccattccatgggtgtccggaacctcggcctctactccagtgtttggggggatcctatccttgatcaatgagcacaggatccttagtggccgcccccctcttggctttctcaacccaaggctctaccagcagcatggggcaggactctttgatgtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttg

SEQ ID NO: 4317 - DNA, 8604 bp, Homo sapiens
gtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaattggcagtggcagagaatccaaactcaacaagtgctcctgaaagaaacgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcccacggaggcctcgagcagagagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcactac

SEQ ID NO: 4318 - DNA, 1507 bp, Homo sapiens
acgacgggggaggtgctgtacgtccaagatggcggcgccctgtaggctggagggactgtgaggtaaacagctgagggggaggagacggtggtgaccatgaaagacaccaggttgacagcactggaaactgaagtaccagttgtcgctagaacagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagtatggtgtcaactagtgtgcctgctctctcctctgctttctggtgaagctgaccctttgggtcagatttagtatgtggttgggaaaatttcacactgctcatttcaggagtcacttttaaggatccatgatattagcaaagaaagttactgttgcctcttagattcatcttgaagtcttgatttacaaaatgcaacttgtttcttgatacgcttttaataagatgcctttttctagatgaaaa

SEQ ID NO: 4319 - DNA, 1333 bp, Homo sapiens
cagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccatctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaagg

SEQ ID NO: 4320 - DNA, 8463 bp, Homo sapiens
cagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaattggcagtggcagagaatccaaactcaacaagtgctcctgaaagaaacgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcccacggaggcctcgagcagagagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcact

SEQ ID NO: 4321 - DNA, 1383 bp, Homo sapiens
cagcacctcttggacaggattaacgaatatgtgggcaaagccgccactcgtttatccatcctctcgttactgggtcatgtcataagactgcagccatcttggaagcataagctctctcaagcacctcttttgccttctttactaaaatgtctcaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcaga

SEQ ID NO: 4322 - DNA, 8310 bp, Homo sapiens
cagtttggtagtggccccaatgaagaaccttcagaacctgtagcacacgtcctggagccagcacagcgccttcgagcgagagaatggcccaacaagcaaatgtcggggagcttcttgccatgctggactcccccatgctgggtgtgcgggacgacgtgacagctgtctttaaagagaacctcaattctgaccgtggccctatgcttgtaaacaccttggtggattattacctggaaaccagctctcagccggcattgcacatcctgaccaccttgcaagagccacatgacaagatggacactgacgtcgttgtcctcacaacaggcgtcttggtgttgataaccatgctaccaatgattccacagtctgggaaacagcatcttcttgatttctttgacatttttggccgtctgtcatcatggtgcctgaagaaaccaggccacgtggcggaagtctatctcgtccatctccatgccagtgtgtacgcactctttcatcgcctttatggaatgtacccttgcaacttcgtctcctttttgcgttctcattacagtatgaaagaaaacctggagacttttgaagaagtggtcaagccaatgatggagcatgtgcgaattcatccggaattagtgactggatccaaggaccatgaactggaccctcgaaggtggaagagattagaaactcatgatgttgtgatcgagtgtgccaaaatctctctggatcccacagaagcctcatatgaagatggctattctgtgtctcaccaaatctcagcccgctttcctcatcgttcagccgatgtcaccaccagcccttatgctgacacacagaatagctatgggtgtgctacttctaccccttactccacgtctcggctgatgttgttaaatatgccagggcagctacctcagactctgagttccccatcgacacggctgataactgaaccaccacaagctactctttggagcccatctatggtttgtggtatgaccactcctccaacttctcctggaaatgtcccacctgatctgtcacacccttacagtaaagtctttggtacaactgcaggtggaaaaggaactcctctgggaaccccagcaacctctcctcctccagccccactctgtcattcggatgactacgtgcacatttcactcccccaggccacagtcacaccccccaggaaggaagagagaatggattctgcaagaccatgtctacacagacaacaccatcttctgaatgacagaggatcagaagagccacctggcagcaaaggttctgtcactctaagtgatcttccagggtttttaggtgatctggcctctgaagaagatagtattgaaaaagataaagaagaagctgcaatatctagagaactttctgagatcaccacagcagaggcagagcctgtggttcctcgaggaggctttgactctcccttttaccgagacagtctcccaggttctcagcggaagacccactcggcagcctccagttctcagggcgccagcgtgaaccctgagcctttacactcctccctggacaagcttgggcctgacacaccaaagcaagcctttactcccatagacctgccctgcggcagtgctgatgaaagccctgcgggagacagggaatgccagacttctttggagaccagtatcttcactcccagtccttgtaaaattccacctccgacgagagtgggctttggaagcgggcagcctcccccgtatgatcatctttttgaggtggcattgccaaagacagcccatcattttgtcatcaggaagactgaggagctgttaaagaaagcaaaaggaaacacagaggaagatggtgtgccctctacctccccaatggaagtgctggacagactgatacagcagggagcagacgcgcacagcaaggagctgaacaagttgcctttacccagcaagtctgtcgactggacccactttggaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgccatgaaagatcagttgaagttacaagagaaggacatccagatgtggaaggttagtctgcagaaagaacaagctagatacaatcagctccaggagcagcgtgacactatggtaaccaagctccacagccagatcagacagctgcagcatgaccgagaggaattctacaaccagagccaggaattacagacgaagctggaggactgcaggaacatgattgcggagctgcggatagaactgaagaaggccaacaacaaggtgtgtcacactgagctgctgctcagtcaggtttcccaaaagctctcaaacagtgagtcggtccagcagcagatggagttcttgaacaggcagctgttggttcttggggaggtcaacgagctctatttggaacaactgcagaacaagcactcagataccacaaaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggcttgactgttgtaatgacgggtgctcagattccatggtagggcacaatgaagaggcatctggccacaacggtgagaccaagacccccaggcccagcagcgcccggggcagtagtggaagcagaggtggtggaggcagcagcagcagcagcagcgagctttctaccccagagaaacccccacaccagagggcaggcccattcagcagtcggtgggagacgactatgggagaagcgtctgccagcatccccaccactgtgggctcacttcccagttcaaaaagcttcctgggtatgaaggctcgagagttatttcgtaataagagcgagagccagtgtgatgaggacggcatgaccagtagcctttctgagagcctaaagacagaactgggcaaagacttgggtgtggaagccaagattcccctgaacctagatggccctcacccgtctcccccgaccccggacagtgttggacagctacatatcatggactacaatgagactcatcatgaacacagctaaggaatgatggtcaatcagtgttaacttgcatattgttggcacagaacaggaggtgtgaatgcacgtttcaaagctttcctgtttccagggtctgagtgcaagttcatgtgtggaaatgggacggaggtcctttggacagctgactgaatgcagaacggtttttggatctggcattgaaatgcctcttgaccttcccctccacccgccctaaccccctctcatttacctcgcagtgtgttctaatccaagggccagttggtgttcctcagtagctttactttcttcctttcccccccaaatggttgcgtcctttgaacctgtgcaatatgaggccaaatttaatctttgagtctaacacaccactttctgctttcccgaagttcagataactgggttggctctcaattagaccaggtagtttgttgcattgcaggtaagtctggttttgtcccttccaggaggacatagcctgcaaagctggttgtctttacatgaaagcgtttacatgagactttccgactgcttttttgattctgaagttcagcatctaaagcagcaggtctagaagaacaacggtttattcatacttgcattcttttggcagttctgataagcttcctagaaagttctgtgtaaacagaagcctgtttcagaaatctggagctggcactgtggagaccacacaccctttgggaaagctcttgtctcttcttcccccactacctcttatttatttggtgtttgcttgaatgctggtactattgtgaccacaggctggtgtgtaggtggtaaaacctgttctccataggagggaaggagcagtcactgggagaggttacccgagaagcacttgagcatgaggaactgcacctttaggccatctcagcttgctgggccttttgttaaacccttctgtctactggcctccctttgtgtgcatacgcctcttgttcatgtcagcttatatgtgacactgcagcagaaaggctctgaaggtccaaagagtttctgcaaagtgtatgtgaccatcatttcccaggccattagggttgcctcactgtagcaggttctaggctaccagaagaggggcagctttttcataccaattccaactttcaggggctgactctccagggagctgatgtcatcacactctccatgttagtaatggcagagcagtctaaacagagtccgggagaatgctggcaaaggctggctgtgtatacccactaggctgccccacgtgctcccgagagatgacactagtcagaaaattggcagtggcagagaatccaaactcaacaagtgctcctgaaagaaacgctagaagcctaagaactgtggtctggtgttccagctgaggcagggggatttggtaggaaggagccagtgaacttggctttcctgtttctatctttcattaaaaagaatagaaggattcagtcataaagaggtaaaaaactgtcacggtacgaaatcttagtgcccacggaggcctcgagcagagagaatgaaagtcttttttttttttttttttttttagcatggcaataaatattctagcatccctaactaaaggggactagacagttagagactctgtcaccctagctataccagcagaaaacctgttcaggcaggctttctgggtgtgactgattcccagcctgtggcagggcgtggtcccaactactcagcctagcacaggctggcagttggtactgaattgtcagatgtggagtattagtgacaccacacatttaattcagctttgtccaaaggaaagcttaaaacccaatacagtctagtttcctggttccgttttagaaaaggaaaacgtgaacaaacttagaaagggaaggaaatcccatcagtgaatcctgaaactggttttaagtgctttccttctcctcatgcccaagagatctgtgccatagaacaagataccaggcacttaaagccttttcctgaattggaaaggaaaagaggcccaagtgcaaaagaaaaaacattttagaaacggacagcttataaaaataaagggaagaaaggaggcagcatggagagaggcctgtgctagaagctccatggacgtgtctgcacagggtcctcagctcatccatgcggcctgggtgtccttttactcagctttataacaaatgtggctccaagctcaggtgcctttgagttctaggaggctgtgggttttattcaactacggttgggagaatgagacctggagtcatgttgaaggtgcccaacctaaaaatgtaggctttcatgttgcaaagaactccagagtcagtagttaggtttggtttggttttggacatgataaacctgccaagagtcaacaggtcacttgatcatgctgcagtgggtagttctaaggatggaaaggtgacagtattactctcgagaggcaattcagtcctgggcaaaggtattagtacaataagcgttaagggcagagtctaccttgaaaccaattaagcagcttggtattcataaatattgggattggatggcctccatccagaaatcactatgggtgagcatacctgtctcagctgtttggccaatgtgcataacctactcggatccccacctgacactaaccagagtcagcacaggccccgaggagcccgaagtctgctgctgtgcagcatggaattcctttaaaaaggtgcactacagttttagcggggagggggataggaagacgcagagcaaatgagctccggagtccctgcaggtgaataaacacacagatctgcatctgatagaactttgatggattttcaaaaagccgttgacaaggctctgctatacagtctataaaaattgttattatgggattggaagaaacacgtggtcatgaatagaaaaaaaacaaacccaaaggtaggaaggtcaaggtcatttcttagatggagaagttgtgaaagatgtccttggagatgagttttaggaccagcattactaaggcaggtgggcagacagtgacctctctaggtgtgtccacagagtttttcaggagagaaaactgcctgacctttgggactaagctgcggaatcttcttactaagcttgaagagtggagaggcgagaggtgagctactttgtgagccaaagcttatgtgacatggttggggaaacagtccaaactgttctgagaaggtgaactgttacgacccaggacaattagaaaaattcacccaccatgccgcacattactgggtaaaagcagggcagcagggaacaaaactccagactcttgggccgtccccatttgcaacagcacacatagtttctggtatatttgttgggaaagataaaactctagcagttgttgaggggaggatgtataaaatggtcatggggatgaaaggatctctgagaccacagaggctcagactcactgttaagaatagaaaactgggtatgcgtttcatgtagccagcagaactgaagtgtgctgtgacaagccaatgtgaatttctaccaaatagtagagcataccacttgaagaaggaaagaaccgaagagcaaacaaaagttctgcgtaatgagactcaccttttctcgctgaaagcactaagaggtgggaggaggcctgcacaggctggaggagggtttgggcagagcgaagacccggccaggaccttggtgagatggggtgccgcccacctcctgcggatactcttggagagttgttcccccagggggctctgccccacctggagaaggaagctgcctggtgtggagtgactcaaatcagtatacctatctgctgcaccttcactctccagggtacatgctttaaaaccgacccgcaacaagtattggaaaaatgtatccagtctgaagatgtttgtgtatctgtttacatccagagttctgtgacacatgccccccagattgctgcaaagatcccaaggcattgattgcacttgattaagcttttgtctgtaggtgaaagaacaagtttaggtcgaggactggcccctaggctgctgctgtgacccttgtcccatgtggcttgtttgcctgtccgggactcttcgatgtgcccaggggagcgtgttcctgtctcttccatgccgtcctgcagtccttatctgctcgcctgagggaagagtagctgtagctacaagggaagcctgcctggaagagccgagcacctgtgcccatggcttctggtcatgaaacgagttaatgatggcagaggagcttcctccccacttcgcagcgccacattatccatcctctgagataagtaggctggtttaaccattggaatggacctttcagtggaaaccctgagagtctgagaacccccagaccaacccttccctccctttccccacctcttacagtgtttggacaggagggtatggtgctgctctgtgtagcaagtactttggcttatgaaagaggcagccacgcattttgcactaggaagaatcagtaatcacttttcagaagacttctatggaccacaaatatattacggaggaacagattttgctaagacataatctagttttataactcaatcatgaatgaaccatgtgtggcaaacttgcagtttaaaggggtcccatcagtgaaagaaactgattttttttaacggactgcttttagttaaattgaagaaagtcagctcttgtcaaaaggtctaaactttcccgcctcaatcctaaaagcatgtcaacaatccacatcagatgccataaatatgaactgcaggataaaatggtacaatcttagtgaatgggaattggaatcaaaagagtttgctgtccttcttagaatgttctaaaatgtcaaggcagttgcttgtgtttaactgtgaacaaataaaaatttattgttttgcact

SEQ ID NO: 4323 - DNA, 6156 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgca

SEQ ID NO: 4324 - DNA, 5532 bp, Homo sapiens
ctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgca

SEQ ID NO: 4325 - DNA, 5502 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgc

SEQ ID NO: 4326 - DNA, 5236 bp, Homo sapiens
aggggggtgcgcctttctccgcgtcggggcggcccggagcgcggtggcgcggcgcggggaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagag

SEQ ID NO: 4327 - DNA, 5424 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggc

SEQ ID NO: 4328 - DNA, 5322 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgc

SEQ ID NO: 4329 - DNA, 1315 bp, Homo sapiens
ttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 4330 - DNA, 1619 bp, Homo sapiens
atttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtag

SEQ ID NO: 4331 - DNA, 1953 bp, Homo sapiens
acagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaatttaatatga

SEQ ID NO: 4332 - DNA, 1135 bp, Homo sapiens
aggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaataccaaaaaaaaaaaaaaaaaaaaa

SEQ ID NO: 4333 - DNA, 1147 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaatacca

SEQ ID NO: 4334 - DNA, 495 bp, Homo sapiens
atggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggttttatatactga

SEQ ID NO: 4335 - DNA, 1906 bp, Homo sapiens
ccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagggctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaacctctaattcactgtatggtcttgatctatttcttctgttttgagagcctccagttaaaatggggctccagtaccagagcagctagcaactctgccctaatgggaaatgaaggggagctgggtgtgagtgtttacactgtgcccttcacgggatacttcttttatctgcagatggcctaatacttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctgggacagccccctgttcctgagatggaaagcacaaatttaatacaccaccacaatggaaaacaagttcaaagacttttacttacagatcctggacagaaagggcataatgagtctgaagggcagtcctccttctctaggttacatgaggcaggaataagaagtcagacagagacagcaagacagttaacaatgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttctggtatgagaaattaaacttgtatacaaaatggttgccaaggcaacataaaattataagaattc

SEQ ID NO: 4336 - DNA, 2714 bp, Homo sapiens
actccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggttaaaa

SEQ ID NO: 4337 - DNA, 4146 bp, Homo sapiens
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 4338 - DNA, 1723 bp, Homo sapiens
cataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgt

SEQ ID NO: 4339 - DNA, 1464 bp, Homo sapiens
agcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctg

SEQ ID NO: 4340 - DNA, 3538 bp, Homo sapiens
ggcagtgtagctgcgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagttgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctctactggtgtgtgcatttaatgacatctaactacagatgccgcacagccacaatgctttgccttatagttttttaactttagaacgggattatcttgttattacctgtattttcagtttcggatatttttgacttaatgatgagattatcaagacgtagccctatgctaagtcatgagcatatggacttacgagggttcgacttagagttttgagctttaagataggattattggggcttacccccaccttaattagagaaacatttatattgcttactactgtaggctgtacatctcttttccgatttttgtataatgatgtaaacatggaaaaactttaggaaatgcacttattaggctgtttacatgggttgcctggatacaaatcagcagtcaaaaatgactaaaaatataactagtgacggagggagaaatcctccctctgtgggaggcacttactgcattccagttctccctcctgcgccctgagactggaccagggtttgatggctggcagcttctcaaggggcagcttgtcttacttgttaattttagaggtatatagccatatttatttataaataaatatttatttatttatttataagtagatgtttacatatgcccaggattttgaagagcctggtatctttgggaagccatgtgtctggtttgtcgtgctgggacagtcatgggactgcatcttccgacttgtccacagcagatgaggacagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacaggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaataaatatgaaacctcatattaaaaa

SEQ ID NO: 4341 - DNA, 2223 bp, Homo sapiens
ctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttgga

SEQ ID NO: 4342 - DNA, 1339 bp, Homo sapiens
caaatgggggagtgagaggccatagctgtctggcatgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaaagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgagg

SEQ ID NO: 4343 - DNA, 3683 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcga

SEQ ID NO: 4344 - DNA, 893 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttgtctctctttcttcctct

SEQ ID NO: 4345 - DNA, 557 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccagacctctcctag

SEQ ID NO: 4346 - DNA, 111 bp, Homo sapiens
atggcgcccgtcgccgtctgggccgcgctggccgtcggactggagctctgggctgcggcgcacgccttgcccgcccaggtggacccgggacccctcttccctcaccccggc

SEQ ID NO: 4347 - DNA, 3595 bp, Homo sapiens
agtccctcgccgaccagtctgggcagcggaggagggtggttggcagtggctggaagcttcgctatgggaagtcgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtta

SEQ ID NO: 4348 - DNA, 2267 bp, Homo sapiens
agctgctgccgtccatggaggccactgggggcgagaagtccagcacgcccatcaaggcccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtt

SEQ ID NO: 4349 - DNA, 1119 bp, Homo sapiens
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 4350 - DNA, 705 bp, Homo sapiens
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 4351 - DNA, 1441 bp, Homo sapiens
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagt

SEQ ID NO: 4352 - DNA, 1625 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 4353 - DNA, 1632 bp, Homo sapiens
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtgtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 4354 - DNA, 1923 bp, Homo sapiens
gtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatga

SEQ ID NO: 4355 - DNA, 6346 bp, Homo sapiens
gaggggagccatcttgtccctctctgcctccgagtttgtatcgttgcctccatctgtgtctgtgtgtctgtattatcgttgtttggcgtgtttttttttttttttgttttttgtcactgcctgcctgggtcctgcccgaggtctccatcctcggtttccctgtccttgccccgggccctgggagtgctctggaaggctgcgcagtattggaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactggg

SEQ ID NO: 4356 - DNA, 6015 bp, Homo sapiens
ctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaa

SEQ ID NO: 4357 - DNA, 6231 bp, Homo sapiens
gtgacgggaaagggggagttcgcggccggtggcggcggtggcgacagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaa

SEQ ID NO: 4358 - DNA, 6210 bp, Homo sapiens
gagttcgcggccggtggcggcggtggcgacagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaa

SEQ ID NO: 4359 - DNA, 2557 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 4360 - DNA, 2140 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 4361 - DNA, 2602 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 4362 - DNA, 2062 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 4363 - DNA, 2117 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 4364 - DNA, 5120 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 4365 - DNA, 1831 bp, Homo sapiens
aaggtgtccaggaagccctgctaagcatctgtcagtgtctccagcacagcaggaggctgttacaggtggcgcctgattcacatctgcaggacaggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctg

SEQ ID NO: 4366 - DNA, 5188 bp, Homo sapiens
tgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 4367 - DNA, 1691 bp, Homo sapiens
agtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgcaca

SEQ ID NO: 4368 - DNA, 1666 bp, Homo sapiens
gaggtataagagcctccaagtctgcagctctcgcccaactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaa

SEQ ID NO: 4369 - DNA, 1825 bp, Homo sapiens
gcaggcgtcgtcccgtcctcccatcccccagcgcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 4370 - DNA, 2065 bp, Homo sapiens
catctgaccccaggcccagctcgtcctggctggcctgggtcggcctctggagtatggtctggcgggtgccccctttcttgctccccatcctcttcttgggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggctgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 4371 - DNA, 3882 bp, Homo sapiens
cacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggctgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 4372 - DNA, 2673 bp, Homo sapiens
atgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggctgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaag

SEQ ID NO: 4373 - DNA, 954 bp, Homo sapiens
atggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagtccaccaaggccattgtggagccagagaagaccacagctga

SEQ ID NO: 4374 - DNA, 2063 bp, Homo sapiens
catctgaccccaggcccagctcgtcctggctggcctgggtcggcctctggagtatggtctggcgggtgccccctttcttgctccccatcctcttcttggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggctgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcc

SEQ ID NO: 4375 - DNA, 1140 bp, Homo sapiens
atggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcaggctggagggactgggtagatacctccactgagaaacagaacacggatgaggggcgctttggtggtcacgtgtctgcccctgtgggagctccaggatga

SEQ ID NO: 4376 - DNA, 2188 bp, Homo sapiens
atggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 4377 - DNA, 1988 bp, Homo sapiens
attgaggaacatggcgttgctggtgcgagtccttaggaaccagactagcatttctcagtgggttccagtatgcagccgattgatacctgtgtctcctacccaaggacagggggacagggctctgtctcgcacttcccagggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacct

SEQ ID NO: 4378 - DNA, 2133 bp, Homo sapiens
caaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 4379 - DNA, 2201 bp, Homo sapiens
attgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 4380 - DNA, 2447 bp, Homo sapiens
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 4381 - DNA, 1554 bp, Homo sapiens
gggttccagtatgcagccgattgatacctgtgtctcctacccaaggacagggggacagggctctgtctcgcacttcccagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtctt

SEQ ID NO: 4382 - DNA, 1239 bp, Homo sapiens
attgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacaccgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgaga

SEQ ID NO: 4383 - DNA, 1055 bp, Homo sapiens
acccggaaatggttattgaggaacatggcgttgctggtgcgagtccttgatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacgg

SEQ ID NO: 4384 - DNA, 1001 bp, Homo sapiens
attgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatgggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacaggtgagtgaccctttccctcccctcccaagtcctggcaacagtgggtcctcctcttgggctttcaggggatcatgagaggtggagttaccaaggaccagcctgagagaattctgaccagatcacatcagcactagacgctgaagaaggagcgccttctgtatgtccaaccatgaactgggccagggagcgggaaatgggaagagagagagaaagaggcatcgagtagtctcctgccctcaggaactttgagtcattcattcactgtgcacctcattgcctactgtgcgcccagtgctatgctagcagctgggcccacagagtcctggcagatatgagcacgtggtgtagtagcagctg

SEQ ID NO: 4385 - DNA, 1224 bp, Homo sapiens
atttcctttccggcggcgcgctgtcgtcacgcgtcccgcgcctcctcgcgcctgcgccgtggttggaaggtcgtccctgtgaccggcttggcggttggagcggctgtcgccatgttgtcggtagcatcccgctcaggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagatacttgtg

SEQ ID NO: 4386 - DNA, 3181 bp, Homo sapiens
gggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaaggtagccttggtttctatggcaacgaagacgaagactccttctgctcccctcacttctcctctccgacatcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggct

SEQ ID NO: 4387 - DNA, 3083 bp, Homo sapiens
ccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagt

SEQ ID NO: 4388 - DNA, 4224 bp, Homo sapiens
cttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtcgagtaaacattgttgatctacaacaggtaattaatgtggacctgattcatattgaaaatagaattggtgacattattaaatcagaaaagcatgttcagttagtgttgggacaactgatagatgagaattatttggatcggttggcagaagaggtcaatgataaattgcaagaaagtggtcaggtcaccatatcagaactgtgtaaaacttatgatcttcctgggaactttctgacacaggcactaactcagcgacttggtagaattatcagtggacatattgatcttgataatagaggagtaatttttacggaagcttttgtagctcgacataaagcacgtatccgtggactattcagtgctattacccggcctacagctgtgaattctttgatttcaaaatatggatttcaggagcagcttctttactctgtgcttgaggaacttgttaatagcggacgcttacgaggcactgtggttggtgggagacaggataaagctgtgtttgtccctgacatctactccaggacacagagtacttgggtggattcctttttcaggcagaatggctatctagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcacctctgctacccacttctttatcagttgaagatgctgccatattgcttcagcaggtgatgagggcattcagcaaacaggcctcaactgtagtctttagcgacactgttgtagtcagtgaaaaatttataaatgactgtacagaactgttccgtgagctgatgcaccagaaagctgaaaaggaaatgaaaaataatcctgtgcatttaatcactgaagaagatctgaaacaaatctccactttagaaagcgttagtacaagtaaaaaggataaaaaagatgagcgaagaaggaaagcaacagagggcagtggaagcatgagaggaggaggtgggggcaatgccagagagtacaaaattaaaaaagtcaagaagaaaggaagaaaagatgatgatagtgatgatgaatctcaatcatcccacactggaaagaagaagccagagatcagttttatgttccaggatgagattgaagattttttaagaaaacacatacaagatgcccctgaggagtttatttcggaacttgctgagtacttaataaaacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcagatgacacacaggctgctcttaccaaacacttgctgaagtcagtgtgtactgatatcactaacctcattttcaacttcttagcttcggatttaatgatggcagtagacgatcctgcagccattacaagtgaaataagaaagaaaattttaagtaaattatcagaagaaaccaaagtagctcttacaaaactccataactctctgaatgaaaagagcatagaagactttatttcttgtctggattctgcagcagaagcttgtgatattatggtgaaaaggggagacaaaaaaagggaaagacagatactgttccaacatcgacaagcactggctgaacagctaaaggtcacagaagaccctgctcttattctgcacctcacatcagtcctgttgtttcagttttcaacccacagcatgctccatgcacctggaagatgtgtcccacagatcattgcttttcttaatagtaaaattccagaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttacaaaaaagaaaaattattactaagcccttgctcttatttttggcagaataaacattgattttggttggggctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaattaaatttcaaatatttaaaaatactattttatataattccttatgacattttaaactttatattttaaaatatttgaatacgaaaagatcagtctacctctactccattctagacaaagtattaatccttagtgaaagtaattaattaaattgccaacttggcattattattaaacttgataggaacgcaacattaaatttaaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgtttactgtgatcttaatgggcagggttaagaaagttatttaaaataaagttacctattctactaaa

SEQ ID NO: 4389 - DNA, 2071 bp, Homo sapiens
gcatgcgcgggccgcttggcgccaattgctgaccgccacagccacagccagggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 4390 - DNA, 2130 bp, Homo sapiens
aaaagaccacgtggggacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaata

SEQ ID NO: 4391 - DNA, 1326 bp, Homo sapiens
gtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggtt

SEQ ID NO: 4392 - DNA, 9967 bp, Homo sapiens
gcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaa

SEQ ID NO: 4393 - DNA, 15320 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatcaaaccacaagtttaaaatcacatgaaagtgtgtttccatgttgacctttgtttaaaaaaaaaaaaaagtgcttattttctctgtcgctaagctcctccagttttgcttttgtcagaattaaacttaacagtagaggtagtcagaaagcttgcatcagactgtcctcatccaaaacgaaatacttcattacccaatgttatgatttcaccattctcagaaaaattacagtcccctgcctccctgggtgtagtgtcgtgaagtagaaaagccttacataaatagtaaacatagaaattcttctggtgccctctggcagccagcaggagtgggtcttgtgactaatccacatggaaaggatagtgcctgtctttcctgttcccttgccataagaaccgtgaaatctctcctttccctgccactcgtttactcatcacctcctcccatcacttccttgtctctagactagagggacccacagttttaagagctacatcatatcatttgttgttttagaagattgtcttcatctaaacaaaaacactaagaaatcagtagatcactagataatgagtcagtgtttttagcatcacattttacaatttacagtttttgtttgattctgtagcccatttttcttgaaggttagaataagaatcttcttgtatttgaaaaccatctgccctaaattacatttaactacaagaaatggctctctgctggagaaatttaagcttgtcttagttgtttggtagtggctatggaatgagaggtgttgagtcttgtgccccttccatgtattatttgctaactaactatattactaggcccttaattccagcacagcatgtcttctggtctatgataattgtgtgaggactaaggcagagtgcctgttccctgccaactctccaccagaaaatcataatcagaaagagtgactttgatttctggtacttgtgatcaaaagcagcttgtgatttcttcacatttgcaaaatactctctgagccaaaaggcacatacagttctccagtgtcttcccttttagagtatacatatttgctgcttttcctttagtgttcacaaaaatcccaaggtcagtttagtgtggctgagttgttgttatctggaccctaaacaatcattaccacctgtagacagttcttacctacccctctcctccacaatcctagtccatttggaggcaactatcctgtggcctccaagtgaataaatctttcttacacttacttacgtgatattttctatcataattatctctctcatttcttccaatagtaatagcggtaatattgttccattgaatatctatgcacctagctcatctcttagaaacatcccacatagtagcatcgtattactctctggtaaaaagaaagattaaattaaaaggactctacacagtgctgaatttcctgcacctaaattattcagttatcacttgccagtattagttgatccttcaggctatgccaagtgccccctcatgtaggcctctgtattaaaaagattgggacaaaatacttgattagtttgcctgtagaagctcaaagtgtgtaccaaatacattgacagtggatgctttcatggctcagccaacacagttcagaggaatcttttcggcttccagggcattgcttgttaccttttgtcaggatcaacccaaatcctcagggatgctgtttttccacactgtaagtcctaactcattagtgggtcatgaaatcaacttaacagctcaagaccagtatattttaaacgtgaaataataaaaaatagaggaacaatagagcatataaaatggttaagtattggttcctgaaatactgtttcagctaaatattctatttactgtgtatactgggtcacaatataaagtgtttcctgttatgaaatgcaatttaaaaaaagaaagcttgaaagactgctgcaggaggcaccggccatccagtgattgttggaagagtctggattgtgtggagcctgaccttagataaggagcagcagatccacaactcaggaagtctagagatgcttagcacttcttcttttgagtgagaagatggaatcactcttggtttctaaaatatttttcttctctgctgtgtatcgggcaacctcacatgattcagtgggaccagaaaaagcatagaaaaattagatccacacacagcacccaaaaaaggccatagtcttttgtttacctagatgtattttaacctctttaccactaagcattttactataatagaactggggacatacattgtccttttgagtccgttgaatctgcaccatctaccttttggctgattcaccatacaggtggcaaaggcctttaaaaatggggagctaatacgtagggcacattctggtagggccaaaatattcagtgtctggggggtgctatgcaaatatcaatgactttttactaaaaacagtggatttcctcatttctttaagatccaagtagaaaatgtaaataacttacattctgtatgcaggactcaatacagacttagtcaatctgattttttttggtgcttttcagtatagcgcaactctaaaaggaaacccattcaccctccttagtcctttgaagtatacttttgaaattataccttattgttaatggcaacctaatcaagctaggatttgtcggttaaaattttgattcttgtaatctgtactgtcaatttttggccactctggctgttacagcaaacttttctcccactgtcataattggtctaaagtagtatttgtttcaggactatccaaaaagcaaggccagcacattgagaagatgcagaatcctactctattacaaacctcactcatgtttcttttattgaaacctttttctactttatatttcctcttttgtaaatttttccatgtcatttaaaaaattttttactttagaattacagattagttctttttttaaagcattatggcattttcaaaaaaaaaattattttggttacccaaaaagctatacaagaaatataacttcaattttttaggttgatatgggtatatttttaaagtttttattactttatacaaatacaaattaatttatattatagtttaacacctgctatgatgatagatatcacactgctatgatagaaaatccctgtctgtcattgaactattcatttagtgttactctgatatgttaataatgtattccttctaatgaagtccttgtaacaagaaaccctgtgagattggtataatgagatatcaaataatcagaagtataattaaaatagaacatgttggaaaatcccaacatttcctgttatgccgtcatacctccggtgttcagtttgttactcaaaagttcccagttcttaggctgaaaaacattcaagtaaaaatgtagcatagattacactgaaatattttcagtatcaatgatttaatatccacacaaactattaggaatggtatctggaacttgttacaaggtcagataaactgttacagaattttagaaataattatctctgtatgtgactgtgtattacatataaaaatgaatttttcaggaaaagtgcactttaaaaatactttctcttgctagttttttaaattgatgaaatagcctgtgctgctttggaatgcttattctttctttgatgaaaatacggtcattgattatgataattttaaaaatatctatttctgcatcgctgcaggatttcctacacttttctgttcctcatccctcttttatgtgtgcttggctcagttgcctgttacacagcctctgccttggttttgtgtattctaagataatttataaacacagatatttacagtgaagttcttccttttgaaactaatcttattcttttattcctctctctaaaaattggttggccatgctcactaatgattttttttcttaacaataagcatttcttggtattggtagatttggattgcatggtaagatgactgcccattttcaccatgtatacctttgtcaaataaagatttctgatctttggtc

SEQ ID NO: 4394 - DNA, 10269 bp, Homo sapiens
aggcgatggggaggaggcggggccgacaggaaagaggagccgggctcggcgcgaaaagggcaccctccagagccgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaaa

SEQ ID NO: 4395 - DNA, 11145 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcagggaataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaa

SEQ ID NO: 4396 - DNA, 1393 bp, Homo sapiens
ccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcg

SEQ ID NO: 4397 - DNA, 1873 bp, Homo sapiens
cggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtaaaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggcccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttc

SEQ ID NO: 4398 - DNA, 3213 bp, Homo sapiens
attcaaggctcagggtggtggctcattttcaaggggctgtgaaaagagagggtcactcctttttgatcatttccctgctgcctggcttcaaatggccctcaggccaggtcactttagggaaattggtgatcgctcttggtattccactttttttttttttttgagacggagtctcgcactgtcaccaggctggagtgcagtggtgcgatctctgctcactgcaccctccgcctcccgggttcaagcaattctcctgcctcagcctcctgagtagctgggattaggcgaatgccacccctgactaatttttgtatttttagtagagacggggtttcaccatgttggccaggctggtctcgaactcctgaccttgtgatccatccgcctcagcctcccaaagtgctgggattataggcatgagccactgcgcctggcgtggaatttcactcaggtcccttcagctctctctggttctgacagatcttgcccaaattcccatggttatgtggtcatttgcttgcctgttgctgggggtggctgggaggtggcactcagctgttcgactctgaggcccaggactcctggctgctgggactcacgtgtgtccctgcacagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggcccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttc

SEQ ID NO: 4399 - DNA, 681 bp, Homo sapiens
ttggggtcgctggggacattgccacatctctctgctcagaatgggtccttgagagcgggctccacgccacccttgctggccttaccctttgctgagtgggcagaacagccagagggcctcagagcccggcgtcctcagggaaggggctggtgtggaatcccctcccgccctgaccagctcctctcttgtcttgcagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactga

SEQ ID NO: 4400 - DNA, 5300 bp, Homo sapiens
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcatcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 4401 - DNA, 974 bp, Homo sapiens
aagtgctgggattacacgcgtgagccaccacgtccagcttcctgttgtctttgaatttatctcctgagcaagtcttcctccgggcgctgtggaaaggcacagatctgagtgcaggcgacagaggctcctgagggggtcgctgccacctccccaatgagcctccgcagcaccaggaaggagccccacccaccagctccagctccaagagacgcagatctctgcttccccacctgcctccctagcccatctgtgctgtctggcatcaaaatcagttttccacagtagttgaaccattttgcacctcccaccaataatgagtaagggttctggttcctctacatccgagccagcagttggccttgtcagtttttaaaattcgagccatcccagctgtgctgactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgac

SEQ ID NO: 4402 - DNA, 592 bp, Homo sapiens
gtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaaggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagg

SEQ ID NO: 4403 - DNA, 798 bp, Homo sapiens
gtagagggctgtacctttttggcgctgtggaagccgttgctgtgctgtatttacagggagtccgaaattgaagttcagaggaagaattgccttccaccgcatcttatcagaccctatgggtgccagggtgtgtgctgggagaagaagacagcaagagagccatgcagggggtgacacagctaccagggacctgcgttagctagcagcaggacggtgaagtcggttctagctctgcgaccttggaccacactgttcactcccatacagtggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccat

SEQ ID NO: 4404 - DNA, 1497 bp, Homo sapiens
atgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtgg

SEQ ID NO: 4405 - DNA, 554 bp, Homo sapiens
aggtcgtgggataggcatatattgagctttgattttgactgcttaacagttttccacagtagttgaaccattttgcacctcccaccaataatgagtaagggttctggttcctctacatccgagccagcagttggccttgtcagtttttaaaattcgagccatcccagctgtgctgactccttagttgctgagatgagcttgtaaaaagcagctctgttgatcccagcagcggccagggcctccgctgcttctcggctgggagacccgagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagagg

SEQ ID NO: 4406 - DNA, 564 bp, Homo sapiens
gatgcccatggtgtccctagagccagctgccacttctctgggcgccaccgtagctcccgacctgctgtccgcaaataaccccaggctgggaaaggcaaaggcgccttggtctctgtggaccctggccaggccccaggctccaggtaggggcccagctggcgctgcctcgcgccctcctcccctccgttctgggaacctgagacgaagcagtggcctcggcgtccctcagtctgttggttgctggtccctgaggacagaagtgaaggtcttggggtagggatcagggcctcggtcaagcccccaggactggcttctaggccccagaccgtgcatacgcaactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcaga

SEQ ID NO: 4407 - DNA, 577 bp, Homo sapiens
gctgcaagtttgcgggacggggagcgcaggccgcagcgtgcgcgggccgggggctggacctttcgggcgcggcgggcagatcgagcctggcactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgag

SEQ ID NO: 4408 - DNA, 582 bp, Homo sapiens
gcaagtttgcgggacggggagcgcaggccgcagcgtgcgcgggccgggggctggacctttcgggcgcggcgggcagatcgagcctggctggtctcagaaggacgtccaccttgggctgttgtgaggattaaatgaattaatccacgagaagctcctagaatggtgcctggtactgtactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgcca

SEQ ID NO: 4409 - DNA, 1402 bp, Homo sapiens
gagtgtgggaggggcgctgggtgggagctcagcctggcccccttggggcaggacccactgccaactcggcacccacagcagggcccaggtgctctgactgtgccgagcgagggacagcaagccgggtcggccaagaggagactgcatgtcagaggtcccagcaggagtttcttcagcccagccgtcctgctggagaagctcgttcgcagatgttgtttctaaggactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgtgagttgccctccccttcccagacagtgtgaggccagcctttggacagagctcagagagagagccctaatcttctggtacaaagcacagtcttggggtaggccaggcgggcagggcaaggtgttgctgcgccctgccaagtcatccgaaccaagacatgtggtgggggtgagcaggctcggggagtgggagggtgacagcttcttcatagatggtggcttcatgtaagcatttgaactaactgaagatatcacattatttgctggctgctgtctctatgagttaggagcacttagcccagctggttgaagtggaaacattattttttttgtttttgttttcagatatgctcatagaagcagatgtgttagcattgtgttgtctgtcagcctggactgagtagatgcctgtttgggctgcagtctccatcaaggccagtggccaccagttaaatg

SEQ ID NO: 4410 - DNA, 3588 bp, Homo sapiens
gcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaag

SEQ ID NO: 4411 - DNA, 1688 bp, Homo sapiens
ccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaatcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 4412 - DNA, 5127 bp, Homo sapiens
ccctctcctccccccgcccccccccggctccatcctccgccgccgcccgagcagctgcggggccgccaccgccgccgccgccgttgcaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgcta

SEQ ID NO: 4413 - DNA, 1575 bp, Homo sapiens
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaagtaagtttcaatagctca

SEQ ID NO: 4414 - DNA, 560 bp, Homo sapiens
attgggcaccgcccacttcgtgggcttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccat

SEQ ID NO: 4415 - DNA, 1374 bp, Homo sapiens
atgagccgcctgcccgccagcccgggcccagccccccgccgcccccgccgtccccgccgccgctgcccgccgccaccggccgcccgcccgcccggctcctccggccgcctccgctgcgctgcgctgcgctgcctgcacccagggctcgggagggggccgcggaggagtcgccccccgcgcccggcccccgcccgccgcgcccgggcccgcgccatggggctctggctgtcgccgccccccgcgccgccgggctagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 4416 - DNA, 979 bp, Homo sapiens
ccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaa

SEQ ID NO: 4417 - DNA, 2286 bp, Homo sapiens
tgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggagaaggggaggaaacttctcccctcccaccttcacctttagcttcttgaaaatgggcccctgcagaataaatctgccagttttt

SEQ ID NO: 4418 - DNA, 3880 bp, Homo sapiens
gggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaatgttgaaccaattgtgaattacttatgtattattcatttctcatggggagagtaatgctgttgaagaacattacattgtaaactgccttcatttttggctctttgtttatgttcaggtttagtttacaaacccatttaagtatggaatgatttatatggggtcaggtgctccacaaaatagacctatgagaccaaaaatgacctaggctatttagacgacagcatgaaacttccacgttagttctcagtctataaaggcacttaccggtctctggtgtggtatgaccaatagaaacaccttatagtttgctttggacctcattttggaaaaataatctgcctttctaattgttctgcataggttaaaatgataaatttacattctttgaacctataccagattgtggtgtccgagtgaccggcacactgtctgacacacagtcagtgtgcacgtatttgtctgagtgaatgaggagacctgagaaaccggtgacgtggcacagggaagccagctggcccaggattccgtacatggccgcaagcagactaacgcgttgacgctaatttaatgtattttacctcacactaaggtcatgcttgataaagacgttaaactcaacttgtaaaatggtagcccagtgctatgcacagagtgggtgctcattagtgttgaatgaacacatttgtaatactacatgtaattccatctgactgctttgttaaattttcagttagaacgtagatactgtaaagtccacacacacattaaatcttgttttcctgaaagtatggcatcaaaaatacttgtagaaaaaccttgtcacaactgatttgaatgttcctattttcttttcctttgactttgatattggcttgtaatgtctcttttcatcatatgtaatatcagtggaacaggcagcgctactcaagtcctaaggattcctcagtgatcagtgatccagggccgttcatgaaccactgggctggatttgactgttgagtgtggcagttaatgcccctcaagaaatcaaaggatgtcttataagtgtcttccaaaaaaaagcaaatgctgaaatcctattggcaaagtaaactgaaattggctgctatattttatataatcatttctgcaaatcccattttttgaatactaatatttgacatggttaattcttattaatttgttggaattgtttattgttaataatgcaaatagataatttttaattatccacaagtaacatttcactgttaatggtttgaaataggtgataagcaaaccaatttgaaataaaatataaacatgtgccattgtattataacactatacactttcttgacagttaaatttaaaaaaaaattttttttggtagcatgtattgtatatgtttatagtatatgtagtaaataaaaatatggccaaatgtttggcttggtgatcttttgcaaaaaagtaa

SEQ ID NO: 4419 - DNA, 2218 bp, Homo sapiens
gctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaa

SEQ ID NO: 4420 - DNA, 2194 bp, Homo sapiens
tgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgcataggctcaagtattgaagactgcatcggcctgatggatagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggaga

SEQ ID NO: 4421 - DNA, 12132 bp, Homo sapiens
ggagcgagcaagcgaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaa

SEQ ID NO: 4422 - DNA, 3897 bp, Homo sapiens
atgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgcataggctcaagtattgaagactgcatcggcctgatggatagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaa

SEQ ID NO: 4423 - DNA, 569 bp, Homo sapiens
atttgttctcctggttccctctctgtgagatcttcttaatctgtgtctttcaagggaaggtcattgctgctctgaaggaagctgcattttgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggac

SEQ ID NO: 4424 - DNA, 12084 bp, Homo sapiens
ggagcgagcaagcgaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaa

SEQ ID NO: 4425 - DNA, 5919 bp, Homo sapiens
attacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttca

SEQ ID NO: 4426 - DNA, 1186 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagttttc

SEQ ID NO: 4427 - DNA, 1020 bp, Homo sapiens
tccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaatt

SEQ ID NO: 4428 - DNA, 4353 bp, Homo sapiens
atttattccaggacctagagagaggcaggatgagggtagagaattaaccccttagtacccaaaagaagcacagaggggtcccaggttgaaaaaggaaatcttttcaccttcccattcatggaatgtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctg

SEQ ID NO: 4429 - DNA, 2723 bp, Homo sapiens
aatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctca

SEQ ID NO: 4430 - DNA, 561 bp, Homo sapiens
attcattacccttccctggatctgggggctttcggaatctcgacctccccttggcctatctcctgcagaaaaattaggcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaact

SEQ ID NO: 4431 - DNA, 4382 bp, Homo sapiens
atttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatgg

SEQ ID NO: 4432 - DNA, 12625 bp, Homo sapiens
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 4433 - DNA, 7154 bp, Homo sapiens
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 4434 - DNA, 9455 bp, Homo sapiens
cttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 4435 - DNA, 5923 bp, Homo sapiens
gctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccagg

SEQ ID NO: 4436 - DNA, 2087 bp, Homo sapiens
caccacgcttcctatgtgacccgcctgggcaacgccgaacccagtcgcgcagcgctgcagtgaattttccccccaaactgcaataagccgccttccaaggccaagatgttcataaatataaagagcatcttatggatgtgttcaaccttaatagtaacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgacctgatcgctgcaaaatgaacccgtgccttaacggaggcacctgttatcctactgaaacttcctacgtatgcacctgtgtgccaggatacagcggagaccagtgtgaacttgattttgatgaatgtcactctaatccctgtcgtaatggagccacttgtgttgatggttttaacacattcaggtgcctctgccttccaagttatgttggtgcactttgtgagcaagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtgtgggccatgattatcagtggataggcctcaatgacaagatgtttgagcatgacttccgttggactgatggcagcacactgcaatacgagaattggagacccaaccagccagacagcttcttttctgctggagaagactgtgttgtaatcatttggcatgagaatggccagtggaatgatgttccctgcaattaccatctcacctatacgtgcaagaaaggaacagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattctatgaaatactttaaaaattcctcatcagcaaaggacaattcaataaatacatccaaacatgatcatcgttggagccggaggtggcaggagtcgaggcgctgatccctaaaatggcg

SEQ ID NO: 4437 - DNA, 4919 bp, Homo sapiens
aatctcatccgctctaaacaacctcatcaaaactactttctggtcagagagaagcaataattattattaacatttattaacgatcaataaacttgatcgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 4438 - DNA, 4651 bp, Homo sapiens
aaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 4439 - DNA, 4914 bp, Homo sapiens
gttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 4440 - DNA, 1868 bp, Homo sapiens
gctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactg

SEQ ID NO: 4441 - DNA, 5023 bp, Homo sapiens
cccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaa

SEQ ID NO: 4442 - DNA, 924 bp, Homo sapiens
attattaacatttattaacgatcaataaacttgatcgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatttaccatatgagccccccaggagatcagcctggaccggtcacggccaccccacgccccagtcgaaaggtacagtgttggctcccatgaccctgagtttcatgtcacaggcagtggatgactgttgatggagtatataataatttctgtggttaatctgtgattttgcaacatgtgatgggtttgttccattgacgacaagagtacaattgatctttcactgcagtgattctttctccatttgggtcatcaggactttcataacaaaaataaaggaatgatgtagtgtatgtcaaccttcacaaatgcatgtttcatgggatgtttgagtacacattaaataatcggtgttttcctgaatcttggccatgcttaaaagtatccctggctttactttatttgactggtggtttccctttatgtgtttatcttagactatgatttattgtaatctgtttggtaagccattccaaattcttttttttttttactttt

SEQ ID NO: 4443 - DNA, 5034 bp, Homo sapiens
gttttcacttggtcggaatggggagagtgtgcaagagatcgctgcgggacaggttcctagagatcgctccgggacggtcgtgacggcccccgagggacatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggacatgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacacc

SEQ ID NO: 4444 - DNA, 1595 bp, Homo sapiens
tccgctctaaacaacctcatcaaaactactttctggtcagagagaagcaataattattattaacatttattaacgatcaataaacttgatcgcattatggccagcactattaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaa

SEQ ID NO: 4445 - DNA, 3936 bp, Homo sapiens
agaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactcgcgcgcacgtggggccgaggccctgctcccggggcctcagggccagccggcgagggacccagccgagtgacagcaggaggcggagggaagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaa

SEQ ID NO: 4446 - DNA, 3766 bp, Homo sapiens
cgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaa

SEQ ID NO: 4447 - DNA, 1033 bp, Homo sapiens
cgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcagggaaacgcaggcctggtagggggtcctgcccagtggatgtcccggcgaacatgatttcgcgaacgggagtgggggcacaggagagcgtgtccgaggtggcctggcgccccggctttgagggtgacttcctggagcggcgccgggcccggaggatctggggcgcccaagacacctgaaggctgcggcaccgcgggaacctgcggggcgcggggtgccatggtcacctgctcgccgcgtccagggcccgggctggggacccctcggtcgtgcgaggagagcgtggggaacctgtcggaaatgagatctggttgcgctgggctgcctttattttctcgttcctacagcatttgaatgaagagatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaag

SEQ ID NO: 4448 - DNA, 972 bp, Homo sapiens
gcccactgccccactgtacccacccaagcactcacctaagctggccatggaaatgtgaatgaaaagcctgacccaggccctcttgccctgctaacccagcaaggaggctctgaccagccagccagcaagtgactttttctgtgacatctaagtggaattcaatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctg

SEQ ID NO: 4449 - DNA, 894 bp, Homo sapiens
cccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcc

SEQ ID NO: 4450 - DNA, 1099 bp, Homo sapiens
gtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 4451 - DNA, 1100 bp, Homo sapiens
gggggcgcggggccggcgggcgtaagcggcggcggcggcggcggcggcgggtgggtggggccgggcggggcccgcgggcacaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 4452 - DNA, 1233 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 4453 - DNA, 1151 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 4454 - DNA, 1114 bp, Homo sapiens
gcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttga

SEQ ID NO: 4455 - DNA, 1868 bp, Homo sapiens
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 4456 - DNA, 753 bp, Homo sapiens
ggtttcctcgttcccctttggttaatgcgcaactgtttcagattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaatt

SEQ ID NO: 4457 - DNA, 2666 bp, Homo sapiens
aagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggccaccgtgattgcccctctgcgcggtgcccgaagtcccgctgaaacctgccgagggcagcaggtctgaaagctgcaggcgctagttgcgcggaggtggcgcagctgctctggaggcgcagagcgaatacgtggtgtttgggtgtggccgccccgcccctggcggtttcctcgttcccctttggttaatgcgcaactgtttcagattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 4458 - DNA, 2272 bp, Homo sapiens
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 4459 - DNA, 2128 bp, Homo sapiens
gcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttgg

SEQ ID NO: 4460 - DNA, 1819 bp, Homo sapiens
ctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggattctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttgg

SEQ ID NO: 4461 - DNA, 5482 bp, Homo sapiens
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgt

SEQ ID NO: 4462 - DNA, 5286 bp, Homo sapiens
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaa

SEQ ID NO: 4463 - DNA, 3144 bp, Homo sapiens
agtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtgtgccaaggacatcgccaaggcctcagatgaggtga

SEQ ID NO: 4464 - DNA, 1386 bp, Homo sapiens
agtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactag

SEQ ID NO: 4465 - DNA, 4412 bp, Homo sapiens
gggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaa

SEQ ID NO: 4466 - DNA, 5534 bp, Homo sapiens
tagggatccttatttgagccacgttgtcctcctttctaatacttctgcccctcaccctgagacccgcctcgcccacccccgctccccagagctccctgtattccgcccttttattcacttgcctcactctctgtcgcctcctcctccctcctgggcattttacttatgctcactcctctggcactctcacacctttatgcagtcattcgtgaccacaagcccggtttttccttccgctcagccctgctgcccttcctttcattccctcctgtggacattttcacctggcgttacctgctgtcaaacggcctcctcccactggggcctttctagactcgggggccctccttggcccctcctcctggcaggaagcaagatggagctgttgggagaggcctgtggaatctgggatctgccgcccctgccggagagaaggctggggcatccgctccccatccacaactttcctggtggctctgcagacccctgtaacccacagctgtgactcataaccgaggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaactgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtat

SEQ ID NO: 4467 - DNA, 1119 bp, Homo sapiens
ctgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgt

SEQ ID NO: 4468 - DNA, 5765 bp, Homo sapiens
tcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgactatgagtgtgtatttattcatgaaatttgaactgtttgccccgaaatggatatggaatactttataagccatagacactatagtataccagtgaatcttttatgcagcttgttagaagtatcctttatttctaaaaggtgctgtggatattatgtaaaggcgtgtttgcttaaacttaaaaccatatttagaagtagatgcaaaacaaatctgcctttatgacaaaaaaataggataacattatttatttatttccttttatcaaagaaggtaattgatacacaacaggtgacttggttttaggcccaaaggtagcagcagcaacattaataatggaaataattgaatagttagttatgtatgttaatgccagtcaccagcaggctatttcaaggtcagaagtaatgactccatacatattatttatttctataactacatttaaatcattaccagg

SEQ ID NO: 4469 - DNA, 1052 bp, Homo sapiens
gattttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaa

SEQ ID NO: 4470 - DNA, 5186 bp, Homo sapiens
cgctcgcggctctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaa

SEQ ID NO: 4471 - DNA, 3470 bp, Homo sapiens
cgctcgcggctctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattaga

SEQ ID NO: 4472 - DNA, 1326 bp, Homo sapiens
tctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatagtaagttg

SEQ ID NO: 4473 - DNA, 2646 bp, Homo sapiens
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaaggctattaaatgtagtagttaactatgcctcttgtctgggggtttcatagagaccggtaggaaagcgcactcctgcttttcgatttatggtgtgtgcaagtaaacaggtgcattgctttcaacctgccatactagttttaaaaattcactgaaattacaaagatacatatatatgcatatatataatggaaagtttcccggaatgcaacaattagcattttaaaatcatatataggcatgcacattctaaatagtactttttcatgcttcattgtttctctggcagataattttactaagaagaaaaatagatattcgactccccttccctaaacaaatccacgggcagaggctccagcggagccgagccccctggttttctcgtaggccctagacggtgttgcatttatcagtgatgtcaaacgtgctcatttgtcagacatagctgtaaatgaaaacaatgtgtggcaaaatacaaagttagttaaataca

SEQ ID NO: 4474 - DNA, 6384 bp, Homo sapiens
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggccccctacacacacacaaacccgcacgcacacaccacacacacacacacacacacacacacaccccacaccctgctcgagtttgtggtggtggtggctgttttaaactggggagggaatgggtgtctggctcatggattgccaatctgaaattctccataacttgctagcttgttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatcctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgattctgtactcagtttcttagtgtacagtttaactgggcccaacaacctcgttaaaagtgtaaaatgcatccttttctccagtggaaggattcctggaggaatagggagacagtaattcagggtgaaattataggctgttttttgaagtgaggaggctggccccatatactgattagcaatatttaatatagatgtaaattatgacctcatttttttctccccaaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaataatacctgtgtggaatataggctgtgctttgatttactggtatttaccccaaaataggctgtgtatgggggctgacttaaagatcccttggaaagactcaaaactaccttcactagtaggactcctaagcgctgacctatttttaaatgacacaaattcatgaaactaatgttacaaattcatgcagtttgcactcttagtcatcttcccctagcacaccaatagaatgttagacaaagccagcactgttttgaaaatacagccaaacacgatgacttttgttttgttttctgccgttcttaaaagaaaaaaagataatattgcaactctgactgaaagacttatttttaagaaaacaggttgtgtttggtgctgctaagttctggccagtttatcatctggccttcctgcctattttttacaaaacacgaagacagtgtgtaacctcgacattttgaccttcctttatgtgctagtttagacaggctcctgaatccacacttaattttgcttaacaaaagtcttaatagtaaacctcccctcatgagcttgaagtcaagtgttcttgacttcagatatttctttcctttttttttttttttcctcatcacaactaagagatacacaaactctgaagaagcagaaatggagagaatgcttttaacaaaaaagcatctgatgaaagattttaggcaaacattctcaaaataagagtgatattctggatgtagttattgcagttatctcatgacaaatgaggcctggattggaaggaaaatatagttgtgtagaattaagcattttgataggaatctacaaggtagttgaatataataagcaggtttgggcccccaaactttagaaaatcaaatgcaaaggtgctggcaaaaatgaggtttgagtggctggctgtaagagaaggttaactcctagtaaaaggcatttttagaaataacaattactgaaaactttgaagtatagtgggagtagcaaacaaatacatgttttttttttcttacaaagaactcctaaatcctgagtaagtgccattcattacaataagtctctaaatttaaaaaaaaaaaaatcatatgaggaaatctagctttcccctttacgctgcgtttgatctttgtctaaatagtgttaaaattcctttcattccaattacagaactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaa

SEQ ID NO: 4475 - DNA, 2347 bp, Homo sapiens
atggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccatcaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtaggcgccggaccccgagcccgcgccgccgtcgccggggacaagttcgcgcaggcctctcggggcctcggctcggactccgcggtacaggacgtggacaccaggcccggcccggccgtgctggccccggtgccaagtctgcgggcgcggggctggaggccccttcgctcccggtccccgttcgcgcgcgtcggcccgggtcgccgtcctgaggttgagcggagaacggtgatttctaaggaaacttgagccaggtctaacttctttccaagcgtccgcttgtacatacgttgaacgtggttctccgttcccaccttcgccctgccagcctagagggaccgcgctgccgtcccttcccgggtggcccctgcctgcccccgccctccttcgttctcttctcagcctccctttccttgccttttttaacttcccctccccgttttaaaatcggtcttattttcgaagtatttataattattatgcttggtgattagaaaagaaaaccttggaggaagccccttctttccccagccggggtccgccctcagtcgcgagtcacagcatgagtcgctcgccaggaggggcccggcccctgcctgccccctccccgcttgcccccgaccctgctaccggcgttccttggaggtcgaagccagggacgtcacccgtgctgtgtccaggcctgctgtcctactatgctcaaccgggggtggggggaggggggtgagtcctgtgctcagtcgggtgggggctggcccggatcccgagctgctgtctctctatgcaccagaacatatctgtaactcctggggaaatacatcttgttttaaccttcaagagaagtgaaagaaaaaagtaatgcacagtatttctagcagaaaatttttttttttaagaggaggcttgggccagagccttctggcatggggcgggtggagaaagtgtttttattttaatttaaattgtgtttcgttttgtttgtggaatctttctttaatgcttcgtcgctctttggactagccgggagagagggcgaggaggcgggtgctccaggccctgtaggctgggccaggcgcctgggggatctgcccgttttcggaggccctcaggggccatcagtgggattccagccgctccacacccctcccctgagcactcggagtggaaggcgcgccgactcgttgaaagttttgttgtgtagttggttttcgttgagttcttttttcatttgctacgaaactgagaaaaagaaaaaaatacacaaaataaatctgttcagatccaagtca

SEQ ID NO: 4476 - DNA, 3393 bp, Homo sapiens
cagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaccatggaaatggtgtttatttagagga

SEQ ID NO: 4477 - DNA, 1813 bp, Homo sapiens
cttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagtt

SEQ ID NO: 4478 - DNA, 1714 bp, Homo sapiens
aaacggcggctcttgagggaggctgggcgcgagattcggcggtgcggacaaaaccctgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatggaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgcc

SEQ ID NO: 4479 - DNA, 5188 bp, Homo sapiens
ggacaaaaccctgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaag

SEQ ID NO: 4480 - DNA, 2148 bp, Homo sapiens
cattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcaaattgtgaatgggaaacagtggtttatgggaagacagaagaccaacttattatgactgaacaagcaagaagatatctgagtacttacacagctaccagtagtacttcaagagctctcatactgtaa

SEQ ID NO: 4481 - DNA, 1944 bp, Homo sapiens
gtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaaaccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctggtccactgtgttaaggtcatttttaaccagcttgctttctacaccaagagtttatgtttgtttaatggctggaaagagaatcttgagatcaaaaaaccaataaagatgtatctctacaa

SEQ ID NO: 4482 - DNA, 1688 bp, Homo sapiens
gtgtgtgctggctgccgggctgccccgagccggcggggagccggtccgctccaggtggcgggcggctggagcgaggtgaggctgcgggtggccagggcacgggcgcgggtcccgcggtgcgggctggctgcaggctgccttctgggcacggcgcgcccccgcccggccccgccgggccctgggagctgcgctccgggcggcgctggcaaagtttgctttgaactcgctgcccacagtcgggtccgcgcgctgcgattggcttcccctaccactctgacccggggcccggcttcccgggacgcgaggactgggcgcaggctgcaagctggtggggttggggaggaacgagagcccggcagccgactgtgccgagggacccggggacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacac

SEQ ID NO: 4483 - DNA, 3256 bp, Homo sapiens
tgcgcctgcagctcgcgctcccgcgccgatcccgagagcgtccgggccgccgtgcgcgagcgagggagggcgcgcgcgcggggggggcgcgcttgtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacacacaataaaggcttgcattcttggaaaccttgaaacccagctctccctcttccctgactcatgggagtgctgtatgttctctggcgcctttggcttcccagcaggcagctgactgaggagccttggggtctgcctagctcactagctctgaagaaaaggctgacagatgctatgcaacaggtggtggatgttgtcaggggctccagcctgcatgaaatctcacactctgcatgagctttaggctaggaaaggatgctcccaactggtgtctctggggtgatgcaaggacagctgggcctggatgctctccctgaggctcctttttccagaagacacacgagctgtcttgggtgaagacaagcttgcagacttgatcaacattgaccattacctcactgtcagacactttacagtagccaaggagttggaaacctttatatattatgatgttagctgacccccttcctcccactcccaatgctgcgaccctgggaacacttaaaaagcttggcctctagattctttgtctcagagccctctgggctctctcctctgagggagggacctttctttcctcacaagggacttttttgttccattatgccttgttatgcaatgggctctacagcaccctttcccacaggtcagaaatatttccccaagacacagggaaatcggtcctagcctggggcctggggatagcttggagtcctggcccatgaacttgatccctgcccaggtgttttccgaggggcacttgaggcccagtcttttctcaaggcaggtgtaagacacctcagagggagaactgtactgctgcctctttcccacctgcctcatctcaatccttgagcggcaagtttgaagttcttctggaaccatgcaaatctgtcctcctcatgcaattccaaggagcttgctggctctgcagccacccttgggccccttccagcctgccatgaatcagatatctttcccagaatctgggcgtttctgaagttttggggagagctgttgggactcatccagtgctccagaaggtggacttgcttctggtgggttttaaaggagcctccaggagatatgcttagccaaccatgatggattttaccccagctggactcggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtagggggtggtaagtactatatatggctctggaaaaccagctgctacttccaaatctattgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatg

SEQ ID NO: 4484 - DNA, 2038 bp, Homo sapiens
aatgcgcctgcagctcgcgctcccgcgccgatcccgagagcgtccgggccgccgtgcgcgagcgagggagggcgcgcgcgcggggggggcgcgcttgtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaaaccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctggtccactgtgttaaggtcatttttaaccagcttgctttctacaccaagagtttatgtttgtttaatggctggaaagagaatcttgagatcaaaaaaccaataaagatgtatctctac

SEQ ID NO: 4485 - DNA, 426 bp, Homo sapiens
gcaccgccaagcggccgccgggccgcatcagccctcctcctgtttgcgctccccagcgtgcaatttatttggggggctaccggggattgaacggagcgggcgagcgctgccaggagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcgg

SEQ ID NO: 4486 - DNA, 3737 bp, Homo sapiens
tgagtgtttatgtttgtagttttaattgctctgaagtaaatatctgattttccaatttccaccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaat

SEQ ID NO: 4487 - DNA, 2696 bp, Homo sapiens
cccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaa

SEQ ID NO: 4488 - DNA, 1143 bp, Homo sapiens
ggatcccgcggcgtccggcccgggtggtctggatcgcggagggaatgccccggagggcggagaactgggacgaggccgaggtaggcgcggaggaggcaggcgtcgaagagtacggccctgaagaagacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgtt

SEQ ID NO: 4489 - DNA, 2819 bp, Homo sapiens
cggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagt

SEQ ID NO: 4490 - DNA, 3419 bp, Homo sapiens
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagt

SEQ ID NO: 4491 - DNA, 1978 bp, Homo sapiens
cggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgctt

SEQ ID NO: 4492 - DNA, 4388 bp, Homo sapiens
agtcttgtagtcgctactttataaccggtccctagaagggggcggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagtaaatgcagtggttcttaaagtggtctcgtctccctaccccacaatattttggtactgccactttgggaagccaaactaggatagtaaattgaccggaacacagttgtggaaatttgacctgaagttagtgaaataaaacttagtagggaaaaaaagcttagcaagaggtctactcctccatagattcatttattgaacttacattggttttattgtcccttgttttctgttccagcttttctgatgcctccactgttcccatggtatcctgaccctctatcttctgttgtaggctgacttcttttatatgaagcaagtaaaggatactaataagaataccactgtagaatcctgaccatacccttaaatagttatgtgatgatgggcaaatgatttcaccctcaggcacttaatatcctcatctgtaaaactaagggattaaactagaactttattaacactttcgagttccactcagaattcctagaggaacatcggtgacttttcactcagaaagtgggtggactaggcctgagtttctttaagttgttgagttacctggtattaggaagacttgtgtgacttgcatagtggactctaatctctcagtctttcttccaagtttgtttatgctgaatgtgatctgcggaacagggttgttagaaatgcagctttttagaaatgcagaattttaatcgataccaggaactactttatttaacaaggctcccaggtatcatgcatgcacattgaagtttgaaaagtaaaggcttaatattttcatgaaataggcttatatccaagcctgccat

SEQ ID NO: 4493 - DNA, 1863 bp, Homo sapiens
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgctt

SEQ ID NO: 4494 - DNA, 2480 bp, Homo sapiens
cgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaa

SEQ ID NO: 4495 - DNA, 3300 bp, Homo sapiens
agtcgactgccagtagggctcgcgcagaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 4496 - DNA, 3085 bp, Homo sapiens
ggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgagaataacaacctgagtgcttctcccagggcgtggtccagacgattttgtttgaggggaagagatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccag

SEQ ID NO: 4497 - DNA, 1686 bp, Homo sapiens
caacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaagg

SEQ ID NO: 4498 - DNA, 2346 bp, Homo sapiens
aatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccct

SEQ ID NO: 4499 - DNA, 3748 bp, Homo sapiens
ggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctc

SEQ ID NO: 4500 - DNA, 3766 bp, Homo sapiens
ggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacgaggaaggtggatgtcagagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctc

SEQ ID NO: 4501 - DNA, 4321 bp, Homo sapiens
catcgaggttttgagaggctaactctcccaaaaaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 4502 - DNA, 4631 bp, Homo sapiens
gccggagcggccaggccgccgtctgcccgtcccgctggacgtcccgcggtccgccctcccgtgcgtccgtctgccggtgagcccgcccgcccgccggcccagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccagggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaattaaaaacaaatttcaaaaactgga

SEQ ID NO: 4503 - DNA, 4099 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacaggtgagggggctgggctgggaagctgatcgacttgtccaccccacagcagaggggcagctagcctagatgcgaacctagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggcggactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctc

SEQ ID NO: 4504 - DNA, 904 bp, Homo sapiens
gcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatag

SEQ ID NO: 4505 - DNA, 3075 bp, Homo sapiens
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 4506 - DNA, 678 bp, Homo sapiens
cttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatag

SEQ ID NO: 4507 - DNA, 2815 bp, Homo sapiens
agtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 4508 - DNA, 2675 bp, Homo sapiens
gtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 4509 - DNA, 3122 bp, Homo sapiens
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 4510 - DNA, 3220 bp, Homo sapiens
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 4511 - DNA, 740 bp, Homo sapiens
agtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactaggtgttacaatccaaaatacatagttgtgatcatttataagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaat

SEQ ID NO: 4512 - DNA, 898 bp, Homo sapiens
agctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaag

SEQ ID NO: 4513 - DNA, 652 bp, Homo sapiens
gcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaat

SEQ ID NO: 4514 - DNA, 5666 bp, Homo sapiens
ggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaaggcttctttagacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagcca

SEQ ID NO: 4515 - DNA, 1083 bp, Homo sapiens
actctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggt

SEQ ID NO: 4516 - DNA, 3028 bp, Homo sapiens
gcagcctcccggcgctgagcgcttttcctgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattgagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaatatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttac

SEQ ID NO: 4517 - DNA, 2003 bp, Homo sapiens
gagcgcttttcctgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaat

SEQ ID NO: 4518 - DNA, 2180 bp, Homo sapiens
gaagaagcccttagcctaatgaagcgataaggtaagcaaaggaggaaggaacaacaaacaacaaattaatcagacaggaagcgaataaccacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacaga

SEQ ID NO: 4519 - DNA, 4587 bp, Homo sapiens
ggctagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattgagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaatatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttctataacttccttgccaaagtcctgatttagtacattagagaacctgtgtttcctctctcctctaccattcatctctcttccatacagtcatttgggctttttactcaaagagaatcaagaaataataaggtataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgggtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcataccatgcactatgtaaacagacacattttgctatctgtgtcatcaggatagtgtaagtggtagggtagagactaccctagacatctgcatctttgtaagttagccagacaataaagaaaagcagaatgata

SEQ ID NO: 4520 - DNA, 4216 bp, Homo sapiens
gcagcctcccggcgctgagcgcttttcctgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattgagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaatatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttctataacttccttgccaaagtcctgatttagtacattagagaacctgtgtttcctctctcctctaccattcatctctcttccatacagtcatttgggctttttactcaaagagaatcaagaaataataaggtataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgggtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcataccatgcactatgtaaacagacacattttgctatctgtgtcatcaggatagtgtaagtggtagggtagagactaccctagacatctgcatctttgtaagttagccagacaataaagaaaagcagaatg

SEQ ID NO: 4521 - DNA, 2568 bp, Homo sapiens
aacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtgagtatttctgccaaggtttttgaagattcacgcttgagtagcctgagtgacactcgggctatatagaaagtccaggcttcttgcctggagtggggtagagaaccctttggagccatctacattctagtaaattccccttccacaggcagtgaggaaattgcagatgcccagaatgcatatgagaaacagttattttaatgtgtcattacaagctcaaaataccgtggtttgctagtattaaattttattattttacttctttggacgtcttcctctgttttcatcttcctgagacagcacaagtagagccatcttctattccttctagttttgaaattggcataatgtctgattaattataacaaaaactccctttaactgccttgatcttttaaacgtattgtaatcatagctttacagagcattacatgaaaatgtaaatatatccataatctctccacataatagatattttcattttaccagattctcatccaattttttatccatataattctgtttttttatgtagttataatgacgatgtacagttttttggcggggtttacataacattgcttagtaaatagtgcccatgttatcacatggtttttatttcagcatatagtaatttaccattaccatggacatttaaattatttctgttgttctgctaatgtaggtaatgctaccataaagaactaaattgcttttcctccattgaagaagaatgtcaacaagaaaggaaaaatagacaaactggaattttataacagtaaatgtataggaagtgttacagctctttgagaatttgtctagcaggctttccagggttttgctggaaagcctctgaaatttacttttaaaaaaacacaatagctgggcatggtggctcacgcctgtaat

SEQ ID NO: 4522 - DNA, 373 bp, Homo sapiens
aatgagaagaagcccttagcctaatgaagcgataagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtct

SEQ ID NO: 4523 - DNA, 4011 bp, Homo sapiens
ttctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 4524 - DNA, 1905 bp, Homo sapiens
gggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 4525 - DNA, 1818 bp, Homo sapiens
tgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 4526 - DNA, 1173 bp, Homo sapiens
aaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttggtaagcatctgtgcctccaagggaggaggagagggaagggcactgccacctgcacaggggccttttgtgagccgggggccacctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaa

SEQ ID NO: 4527 - DNA, 1828 bp, Homo sapiens
ccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaaggtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 4528 - DNA, 3203 bp, Homo sapiens
atgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaaagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctt

SEQ ID NO: 4529 - DNA, 2799 bp, Homo sapiens
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccggcagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaa

SEQ ID NO: 4530 - DNA, 3122 bp, Homo sapiens
tgagtgaatggagcggccgagcctcctggctcctcctcttccccgcgccgccggcccctcttatttgagctttgggaagctgagggcagccaggcagctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaa

SEQ ID NO: 4531 - DNA, 3032 bp, Homo sapiens
gggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaaggggtaaggttttctctattccattgcctttccacagtaacttatacctgtttgaaccatttcaaaggtgcttagaacttatgaagaaagtacagttttagaagaaagggcaaagctctctgtgacattagaacgctttcctccttcccctagttgagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaa

SEQ ID NO: 4532 - DNA, 2466 bp, Homo sapiens
gctttcaccactgcccctcccggggggacctgaaggagagggtttgaggccggtctttgcccgccgaggtctgcgtgtccggtctgggaggaggcctaggagggctcgcgggccacgggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaa

SEQ ID NO: 4533 - DNA, 2114 bp, Homo sapiens
agctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcat

SEQ ID NO: 4534 - DNA, 2768 bp, Homo sapiens
ctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattc

SEQ ID NO: 4535 - DNA, 578 bp, Homo sapiens
agattcatttcgcttgcccgcgctgctcctgcggaagagctgcagtttatttttggggggtgaacaaccttctctgtcgatcaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacgg

SEQ ID NO: 4536 - DNA, 551 bp, Homo sapiens
cttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcgggg

SEQ ID NO: 4537 - DNA, 2421 bp, Homo sapiens
gctttcaccactgcccctcccggggggacctgaaggagagggtttgaggccggtctttgcccgccgaggtctgcgtgtccggtctgggaggaggcctaggagggctcgcgggccacgggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaagg

SEQ ID NO: 4538 - DNA, 1930 bp, Homo sapiens
cttaacccgccgcctccgctctccccggctgcaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacatccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccaggcaa

SEQ ID NO: 4539 - DNA, 1638 bp, Homo sapiens
agatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccaggc

SEQ ID NO: 4540 - DNA, 453 bp, Homo sapiens
agctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggagggataagccccagctccgggtcctcgactctgctgcctcgcctggactcctgattcctcattcctctcctttccgtcccaggcggcgtgcaggaccagcggcggccgtgcaggcggaggacttcggcgcggctcctcctgggtgtgaccccgggcgcgcccgccgcgcgacgatgagggcgcggccgc

SEQ ID NO: 4541 - DNA, 5837 bp, Homo sapiens
agttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagcttttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctccacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgaataagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatcc

SEQ ID NO: 4542 - DNA, 491 bp, Homo sapiens
caggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattc

SEQ ID NO: 4543 - DNA, 6042 bp, Homo sapiens
agtctgcggccactgggcagaacggcaagggagagggggaagggcggagggacgcagcctgggggcgatttgccgggcggagacgctctttttcagacaccctcctcaggtcttttgcacaatcacgcccacatttggggttggaaagccctaattaccgccgtcgctgatggacgttggaaacggagcgcctctccgtggaacagttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagcttttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctccacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgaataagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatcca

SEQ ID NO: 4544 - DNA, 959 bp, Homo sapiens
ccagggctttgactcaacagaattgagacacgtttgtaatcgctggcgtgccccgcgcacaggatcccagcgaaatcagatttcctggtgaggttgcgtgggtggattaatttggaaaaagaaactgcctatatcttgccatcaaaaaactcacggaggagaagcgcagtcaatcaacagtaaacttaagagaccccggatgcttccgttgtttaaacttgtatgcttgaaaattatctgagaggcaataaacatctgctcctttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcagggtg

SEQ ID NO: 4545 - DNA, 1299 bp, Homo sapiens
actcgcctccgtgctcctctcgcccatggaattaattctggctccacttgttgctcggcccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttattttt

SEQ ID NO: 4546 - DNA, 2976 bp, Homo sapiens
actaactcgcggctgcaggatcagcgtctggaagcagacgtttcggctacagacccagagaggaggagctggagatcaggaggcgtgagccgccaagagtttgcagaatctgtggtgtgaatgaactgggggcacctgggcgcacagatcgccccccttcccccgccccgggccacagttgagtagtggtacatttttttcaccctcttgtgaagaatttctttttattattatttgtcgtaaggtcttttgcacaatcacgcccacatttggggttggaaagccctaattaccgccgtcgctgatggacgttggaaacggagcgcctctccgtggaacagttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagaaatgacagtacttattaattgagtccctaaggaatattcagcccactacatagatagcttttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggt

SEQ ID NO: 4547 - DNA, 2184 bp, Homo sapiens
tattcttccaaatggaaactgctaatttttgaagcagaaggttgacagcttcagtaagatctcaagagagcgagaagactggaatcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggcgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgg

SEQ ID NO: 4548 - DNA, 2303 bp, Homo sapiens
ggctctagttaccgtgtcagcctgtcctgggggcagtcacagccacagtgaccattagcaggcacccaggcctgtctttggctcggaaacggtggcccccaatgtagcctagtttgaacctaggaactgcaggaccagagagattccactggagcctgatggacgggtgacagagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggcgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatggaggttttgctccctttccttatttggacccac

SEQ ID NO: 4549 - DNA, 1437 bp, Homo sapiens
aaatgctccagatcctcagtgttcaagaacctcaggaagcttcgcagtcctgcctcgtgcctgcttgaacagctggatgtgggcaggaggctgtgggagcgggccatgccagcagaatcccgccttactctggggacttactcttgtcacagcccctggtgtcctgagggtcatttcagtgtcatggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaat

SEQ ID NO: 4550 - DNA, 4435 bp, Homo sapiens
atgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtccctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctttgatctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaagcaccaccacctccaccaccatcaaggggagggccacctcctcctcctccccctccacacaactcaggtcctcctcctcctcctgctaggggaagaggcgctcctcccccaccaccttcaagagctcccacagctgcacctccaccaccgcctccttccaggccaagtgtagcagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaataa

SEQ ID NO: 4551 - DNA, 4325 bp, Homo sapiens
agtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtccctgttgctcaccccgcaggagaacgagtccctcttcactttcctcggcaagaaatgtgtgactatgtcttcagcagtggtgcagttatatgcagcagatcggaacttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctttgatctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaagcaccaccacctccaccaccatcaaggggagggccacctcctcctcctccccctccacacaactcaggtcctcctcctcctcctgctaggggaagaggcgctcctcccccaccaccttcaagagctcccacagctgcacctccaccaccgcctccttccaggccaagtgtagcagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaat

SEQ ID NO: 4552 - DNA, 2238 bp, Homo sapiens
gccccactcctcgctcgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctga

SEQ ID NO: 4553 - DNA, 120 bp, Homo sapiens
aagaaaagaaaagaaaagaaaagagaaaagaggagaggaaaggaaaggaaagagttgttcaagttggtttcccatgtcttggaaaacaggatggggtggcagcatttgaagtggatgtga

SEQ ID NO: 4554 - DNA, 1095 bp, Homo sapiens
atggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctcaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcagcgagaggctgatccaagaacggcttgccagtccggctaagtggagctcagagcggatgggcacacacacccgccctgtgtgtgtcccctcacgcaagtgccaggggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctga

SEQ ID NO: 4555 - DNA, 735 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggaaaacaaaataccaccctccgccagaaaagtgcagaataaaaattttccactagcaaaagaaggaaaaaataaaagatcttgaatagtctcatc

SEQ ID NO: 4556 - DNA, 936 bp, Homo sapiens
atggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctga

SEQ ID NO: 4557 - DNA, 705 bp, Homo sapiens
atggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 4558 - DNA, 1370 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 4559 - DNA, 642 bp, Homo sapiens
atggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggaaaagccagctgccatgttgggaggatactcaagcatacccgtgtagaagaactgagcctcctgccaacagccatcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctga

SEQ ID NO: 4560 - DNA, 2482 bp, Homo sapiens
gtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatca

SEQ ID NO: 4561 - DNA, 525 bp, Homo sapiens
tcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgca

SEQ ID NO: 4562 - DNA, 1850 bp, Homo sapiens
agaaaggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagcatc

SEQ ID NO: 4563 - DNA, 1777 bp, Homo sapiens
ggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgc

SEQ ID NO: 4564 - DNA, 1824 bp, Homo sapiens
gcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagaggtaaaactacttaagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagca

SEQ ID NO: 4565 - DNA, 1690 bp, Homo sapiens
ccggactgaccggatccgccacgctgggaacctagggcggcccagggctcttttctgtactttttaactctctcgttagagatgaccagagctggggatgcgggcacctgtcttccaggccctcttgctgtgtggccgcagactggtggttcagcctcttaactcggacatgaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaa

SEQ ID NO: 4566 - DNA, 1417 bp, Homo sapiens
ggctcgcctcggcgtgcagtgcgcgtgcgtggagctgggagctaggtcctcggagtgggccagagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctga

SEQ ID NO: 4567 - DNA, 3832 bp, Homo sapiens
atacaccggaaatagagagaaacctgttgtgctctttcctgcttcccgcagttttttagtggccacgggtatggggtggagcttcctttaggggcgtgactaggcctccaacgaaggggcgtggccaagcgcaccgcctcggggcggggccggcgttctagcgcatcgcggccgggtgcgtcactcgcgaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaagacaagagaaagaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggctaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatgagtgttaaactagattgtattcattactagataaaatgtataaagctctctgtactaaggagaaatgacttttataacattttgagaaaataataaagcatttatctaaa

SEQ ID NO: 4568 - DNA, 2712 bp, Homo sapiens
atggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggcgaagacaagagaaagaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggctaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtga

SEQ ID NO: 4569 - DNA, 2944 bp, Homo sapiens
actcgcgaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggctaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcac

SEQ ID NO: 4570 - DNA, 557 bp, Homo sapiens
gcatcgcggccgggtgcgtcactcgcgaagtggaatttgcccagacaagcaacatggctcggaaacgcgcggccggcggggagccgcggggacgcgaactgcgcagccagaaatccaaggccaagagcaaggcccggcatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaag

SEQ ID NO: 4571 - DNA, 1868 bp, Homo sapiens
tcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatgagtgttaaactagattgtattcattactagataa

SEQ ID NO: 4572 - DNA, 177 bp, Homo sapiens
atgtgcagcgatggtgagaaggcagaaaaaagaagcatagctggtatagaccagtggctagaggtgttctgtgagcaggaggaaaagtgggtatgtgtagactgtcggtgtggtgggccagcctctgacctgttacaagtacgccaccaagcccatgacctatgtggtgggcattga

SEQ ID NO: 4573 - DNA, 569 bp, Homo sapiens
aagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtggtgacggctgggtccgagatgtcacacagaggtacgacccagtctggatgacagtgacccgcaagtgccgggttgatgctgagtggtgggccgagaccttgagaccataccagagcccatttatgg

SEQ ID NO: 4574 - DNA, 3565 bp, Homo sapiens
ggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctct

SEQ ID NO: 4575 - DNA, 3622 bp, Homo sapiens
ggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctct

SEQ ID NO: 4576 - DNA, 3074 bp, Homo sapiens
atgtctctccattacggttgctgctgccctgagtgcacatctgtggccataaaggaaatgatgtgggtgattcggccaagagttgcctgtgtggtcaaggatgccggcagcgcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctct

SEQ ID NO: 4577 - DNA, 737 bp, Homo sapiens
ggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataa

SEQ ID NO: 4578 - DNA, 3622 bp, Homo sapiens
ggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggtgagtgagatggggtctgggaggggcaagtgttccatcctccctgcaagaaagaaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctct

SEQ ID NO: 4579 - DNA, 8584 bp, Homo sapiens
tcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattcttt

SEQ ID NO: 4580 - DNA, 8591 bp, Homo sapiens
tgacggaccgcgcccggtgtctctttgaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 4581 - DNA, 390 bp, Homo sapiens
atgtgcgcgcgctaggtcagcttctcggttccagccgggcgggggggtcgggtgggggtgggggtaggggttgcaagggcctcattttttcttactgcccccatccggttcggggaggtggcgggaccttggcggcgcccggagccggcgtggcgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagaca

SEQ ID NO: 4582 - DNA, 528 bp, Homo sapiens
gctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgagg

SEQ ID NO: 4583 - DNA, 1620 bp, Homo sapiens
ttcttactgcccccatccggttcggggaggtggcgggaccttggcggcgcccggagccggcgtggcgctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaa

SEQ ID NO: 4584 - DNA, 2654 bp, Homo sapiens
tctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatc

SEQ ID NO: 4585 - DNA, 2661 bp, Homo sapiens
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgt

SEQ ID NO: 4586 - DNA, 2102 bp, Homo sapiens
ctcgcgcgcttgcgcactttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccagaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggacaatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctc

SEQ ID NO: 4587 - DNA, 2102 bp, Homo sapiens; identical to SEQ ID NO: 4586

SEQ ID NO: 4588 - DNA, 1485 bp, Homo sapiens
ccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagcttcctcagaaggtacccccccaacacaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgca

SEQ ID NO: 4589 - DNA, 1994 bp, Homo sapiens
actttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccagaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggacaatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctc

SEQ ID NO: 4590 - DNA, 3067 bp, Homo sapiens
tttgactggccgtagagtctgcgcagttggtgaatggcgttggtggcgggaaagttgagtctctcctgcgccgagccttcggggcgatgtgtagtgccttccatagggctgagtctgggaccgagctccttgcccgacttgaaggtagaagttccttgaaagaaatagaaccaaatctgtttgctgatgaagattcacctgtgcatggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctct

SEQ ID NO: 4591 - DNA, 2563 bp, Homo sapiens
actcagggtgctaggcgcctattggaggagaaggccgagaggagcaggacggcgggaagaggagtgcggaacccgcgggagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgca

SEQ ID NO: 4592 - DNA, 2622 bp, Homo sapiens
ctattggaggagaaggccgagaggagcaggacggcgggaagaggagtgcggaacccgcgggaggtgaggcccgccgagccgggctgcgagccgggctgcgagccgggcggcagcggggtcggaggtcgtgggcggcagcggagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 4593 - DNA, 3018 bp, Homo sapiens
ctccctgagcaggctgaacatgggcatacgagtgaccagcgtgatcgtgtccaggccagtgccgcattctgtgtggtccaagggaaaaccttctccaagtccacggcccgccctttcctctgctgggttacggccaagggcgccaggcctcactggaggacatggatcctggacccggccctcgaggctgctgccttccagtttccccatgtcctggacactcttggtctcaccatttgggaggccgacaggggatgcagagtggcctgttggaaaggccttatgtgaccccaggctgagtccctgagcagcctgctgaggccggaggggagaagagctgagcttctcccttgctgggccaggctcgggctgtggaatggctgccagctcccttcctgggagaggctgggtggggtccacagcaccttcctcccgtcccacaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 4594 - DNA, 560 bp, Homo sapiens
ctattggaggagaaggccgagaggagcaggacggcgggaagaggagtgcggaacccgcgggaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggca

SEQ ID NO: 4595 - DNA, 572 bp, Homo sapiens
agatttgttctcgggttcacagtgctcagaggggaggagaggggaggaggtgaagacacctggcagggaagcagggcctccatggatggggtgcattcacggcagggagttctcagcaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgagg

SEQ ID NO: 4596 - DNA, 2539 bp, Homo sapiens
gagtgcggaacccgcgggagactttgagccaggcctgttaaaccaagttctcagcaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 4597 - DNA, 2584 bp, Homo sapiens
cgagaggagcaggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 4598 - DNA, 562 bp, Homo sapiens
attggaggagaaggccgagaggagcaggacggcgggaagaggagtgcggaacccgcgggagagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatc

SEQ ID NO: 4599 - DNA, 535 bp, Homo sapiens
attggaggagaaggccgagaggagcaggacggcgggaagaggagtgcggaacccgcgggaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcat

SEQ ID NO: 4600 - DNA, 801 bp, Homo sapiens
gtatgattccacgaatcacacggtttattgtcaaagaagatttgttctcgggttcacagtgctcagaggggaggagaggggaggaggtgaagacacctggcagggaagcagggcctccatggatggggtgcattcacggcagggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaa

SEQ ID NO: 4601 - DNA, 1696 bp, Homo sapiens
cgggatttagatcacgtcccgcaggccggcggaagtagctgatactctcattggttgcaaaaccttgatctgtgaaagcgggcgttttggaagataccggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaagcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattg

SEQ ID NO: 4602 - DNA, 1579 bp, Homo sapiens
cggaagtagctgatactctcattggttgcaaaaccttgatctgtgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagttt

SEQ ID NO: 4603 - DNA, 1530 bp, Homo sapiens
tgaaagcgggcgttttggaagataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaagcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagttt

SEQ ID NO: 4604 - DNA, 1636 bp, Homo sapiens
accggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaagattttgtgtttttaataaaatgtgtt

SEQ ID NO: 4605 - DNA, 1088 bp, Homo sapiens
accggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgtgtctata

SEQ ID NO: 4606 - DNA, 3428 bp, Homo sapiens
acggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtg

SEQ ID NO: 4607 - DNA, 3761 bp, Homo sapiens
agaaaccccacaaaaattagctgggcttggtggcacacacctgtggtcccagctacctgggaggctgagctctggatcgtacaagaagggagacaaggaccactgacaagatatgcgtttcaggcggctcaaacaccacacgctcccgactacggcggaatggagagaatgtgcgcatgctcggcgggaatctgcgcatgctcggcgggaatctgcgcatgctcggagagaatctgcgcatgctcggccggaatctgcgcgagctcggcgggaatctgcgcaagctcggcgggaatctgcgcatgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaattgctgctaa

SEQ ID NO: 4608 - DNA, 2709 bp, Homo sapiens
gcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 4609 - DNA, 2296 bp, Homo sapiens
gtaggaaggggcggggctttgccgaagggggcggggctctcgctgatgggttggctttcgtcagggacataggtagaagctggttggggagtgtgcgtgccagcctgacgcgatatagtgcgcacatgcgtgatgacgtagagggcgttgattgggaccgagtacagggcccgcgcatgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 4610 - DNA, 2025 bp, Homo sapiens
tcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttacttt

SEQ ID NO: 4611 - DNA, 1998 bp, Homo sapiens
atgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactat

SEQ ID NO: 4612 - DNA, 1958 bp, Homo sapiens
cgcctagtgagcagtagccaacatgtcagggtgggagtcatattacaaaaccgagggcgatgaagaagcagaggaagaacaagaagagaaccttgaagcaagtgtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttg

SEQ ID NO: 4613 - DNA, 2200 bp, Homo sapiens
aagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 4614 - DNA, 1995 bp, Homo sapiens
gtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtgtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtact

SEQ ID NO: 4615 - DNA, 1245 bp, Homo sapiens
ggctgcccttcttccctgcggagggagggcctgggcggtcgcgttggcgggagggaggttacctttcccagtctcgctctggccgcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatggaaatgtcagtggaggttttgatgcttcaacatctcagatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatgagcacaatgacatttttatattacagagcttccatcatcatgaagaaaaaaaaatttggttctcaagtgaacaaacatataaaatgtaaacaatccctacaatccagataaaacagagaagactgtgattctagcatattatcagaaaaagtaactatggcaaaaaatgaaactgctttaaactccaaggcagaaattgtatctttatagctaaccatttagtaaataaatacattacatttttgtattttagtcatttgtttttattacatgtgattattttaaaatttgattatgaaacctgtgaagtgtgctcttccatgatgttgataggtgaccactgttggtatttacattaaatgtaaagaaatgtgtactga

SEQ ID NO: 4616 - DNA, 5386 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 4617 - DNA, 5218 bp, Homo sapiens
aaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 4618 - DNA, 5374 bp, Homo sapiens
aaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttggtaaagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 4619 - DNA, 1638 bp, Homo sapiens
ctgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatc

SEQ ID NO: 4620 - DNA, 1490 bp, Homo sapiens
atggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattct

SEQ ID NO: 4621 - DNA, 5332 bp, Homo sapiens
aaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 4622 - DNA, 2393 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgc

SEQ ID NO: 4623 - DNA, 3759 bp, Homo sapiens
ggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagagg

SEQ ID NO: 4624 - DNA, 4158 bp, Homo sapiens
taaagtgaagcgtaacgcgcgagtggtgagatcgtcctgtcctgcgcttaacagtacaggtggaccaaaggggctcccggccaaatacttctggttggagggtggggagggagtgctctctcaaaaccactcctggaatggcttaactcgcccagcacgaatcaatgacaacctcccgccggctgcggcaggctcccgcgagcagcgcggccgcgtggattcccagcccgggaccctggcggcgctcaggacacggcccgggcacgagcgcggcgtccccggggcggccagggctctggctgagaacatggccaatgacattgatgagctcattggcattcccttccccaaccacagcagtgaggtcctgtgcagcctcaatgagcaacggcacgatggcctgctgtgtgacgtgctcctggtggtgcaggagcaggagtatcggacccaccgctccgtcctggctgcctgcagcaagtacttcaagaagcttttcacagccggcaccctagccagccagccctacgtctatgagatcgactttgtccagcctgaggctctggctgctatcctggagttcgcctacacctccacgctcaccatcaccgctggcaatgtcaagcacatcctcaacgcagccaggatgctggagatccagtgcatcgtgaacgtgtgcctggagatcatggagcctgggggggacgggggggaggaggatgacaaggaggacgatgacgacgacgaagatgatgatgatgaggaggacgaagaggaggaggaggaagaggaggaggatgacgatgatgacacggaggactttgctgaccaagaaaacttgcctgacccccaggacatcagctgccaccaaagcccttccaagacagaccatctcacagagaaggcctattcagacacccccagggacttccctgactccttccaggctggcagtcctggccatctgggggtgatccgggacttctccatcgaatctctgctaagggagaacctgtaccccaaggccaacatccccgacaggagaccctccttgtctccattcgccccggacttctttccacacctctggccaggggacttcggtgcctttgcccagctgcctgagcagcccatggacagtgggccactggatctggtcatcaagaatcggaagatcaaggaggaggagaaggaggagctgcccccacccccaccgccacccttccctaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcctgctgcgtggagggccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacacagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcattttaaaaacacaaagggaaaatgggaaaataataataatactatcagtgatggcattttcccgggctcctaaagcagctgcctccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaggaaacatgaataaattggaatccagtggtgttggggcttttgtttttattttgtaaaggtgatgacttcttataaactcaatttttcagatg

SEQ ID NO: 4625 - DNA, 704 bp, Homo sapiens
aggaggacgccaggactgcgtcccggagccaagtgcgggaggcgcgcagggccggcggcgcgcggagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttgtgccaggcagcacctggaagctctgggaaatccacgagaagcagcaggcattggctctgttttggaggagctttcagtccagttcaggaagagaagacacctgcatatgagacaaagaactttatgaccagacagagctgctctaagctgtgggccaacaggaggctgggagctctcctctaaattgctttgtgaccttggacaagaaccctccccttcctggactgcaaatttcctcctctgtaaaatgaagggttgggctctggctgagaacatggccaatgacattgatgagctcattggcattcccttccccaaccacagcagtgaggtcctgtgcagcctcaat

SEQ ID NO: 4626 - DNA, 430 bp, Homo sapiens
gtgtgtgtgtgtatgtgtacacacacagaacatgaagaactacatccagaagctgcccagaaaggatgcagatcccctctgagcagctgggagctcagaagctctgtccaaccctgaggagtgggtcagccacaagagcaagaagtgatggcgtggagtccacccagggcctgaggcatgagcagaatccacgcccattagacctggagcctgggcgtttggggctgcactgctggggagatccaagaagaatcaatgctttggcccctggtgacatgtacatggtgtaatgacaggaaatgagcagatttgcagaaaaactggtgtcctgaaatttaaaactaaggcatcggtgcttggctctggctgagaacatggccaatgacattgatgagctcattggcattcccttccccaaccacagcagtga

SEQ ID NO: 4627 - DNA, 5140 bp, Homo sapiens
gtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaa

SEQ ID NO: 4628 - DNA, 5990 bp, Homo sapiens
gggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctt

SEQ ID NO: 4629 - DNA, 887 bp, Homo sapiens
agacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagca

SEQ ID NO: 4630 - DNA, 6246 bp, Homo sapiens
agacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctta

SEQ ID NO: 4631 - DNA, 6267 bp, Homo sapiens
tttctccctcccctctgggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctt

SEQ ID NO: 4632 - DNA, 3240 bp, Homo sapiens
gggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaacataaaaagaaaaaa

SEQ ID NO: 4633 - DNA, 2312 bp, Homo sapiens
atttagacacaagcgagaggatcatggcggatggccccaggtgtaagcgcagaaagcaggcgaacccgcggcgcaataacggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattg

SEQ ID NO: 4634 - DNA, 3315 bp, Homo sapiens
aagcgagaggatcatggcggatggccccaggtgtaagcgcagaaagcaggcgaacccgcggcgcaataacggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaact

SEQ ID NO: 4635 - DNA, 3306 bp, Homo sapiens
aagcgagaggatcatggcggatggccccaggtgtaagcgcagaaagcaggcgaacccgcggcgcaataacggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgataggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagt

SEQ ID NO: 4636 - DNA, 5972 bp, Homo sapiens
gggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaagtttaccagaacagtgtttattctgtccaggaagaacccttgaacttgtcttgaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgcctt

SEQ ID NO: 4637 - DNA, 1205 bp, Homo sapiens
ggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatc

SEQ ID NO: 4638 - DNA, 3466 bp, Homo sapiens
atttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacataaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaact

SEQ ID NO: 4639 - DNA, 6280 bp, Homo sapiens
catgccgtttaatatcatgctctcccttccctgctaagtttctctatggcctttctcgtttctcctcctgcctccctacacactctcccttactttgtagtgaggtctccccgaggtgtagagagattcagagatcggccaaccgagtgttctattttaatttacttagagaccctttattaaaatgccaaactactttttaatattgggatccagtccagaaattcatcatgcacacaccctaatacacatgccctaagatgcagctcccatgcagcatttttttttctggctctggtacctaaaaagaaaaaaataacaataagagaaagggcagagaactttgttccagaagctgtactgagatacctacacaatttgatgtgcatctcaaatctggtcattagagatatctgtataagaagagactatctggattgaggacccgggatctttccctttaactttcgccccttggagttctccagttctgtgaatggtgtgcaccgttttccgccctgtactctgtaggatttagtgatgaggataatgatgccaaaggcttgacgggcggggaggggggggtggagggggggagaagggagggaggggggagggaggcgaaggcgaaagggagggagaggaggaagggagggaggtggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatga

SEQ ID NO: 4640 - DNA, 1812 bp, Homo sapiens
atttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaagcggccgggcgcagtggctcacgcctttaatcccagcacttttggaggctgaggtaggcagatcacgaggtcagaagatcgagactctcctggctaacatggtggaaccccgtctctactaa

SEQ ID NO: 4641 - DNA, 1514 bp, Homo sapiens
atcatttagtagagcttaaaagtattgccgtagtggttggactttctctttcctttcttaagggaaaaaaaaaattctactggaactatttaagggaaccagtgtgggggagcatgtgtgtgagtgagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcactta

SEQ ID NO: 4642 - DNA, 590 bp, Homo sapiens
aacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacaggtga

SEQ ID NO: 4643 - DNA, 5266 bp, Homo sapiens
agtcaagcggtcttactgtaccgccgtgtgcattccctcatacggtcaggagttatgactcattttgaagatgtaattcttgtctctctgatcccctcgcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaact

SEQ ID NO: 4644 - DNA, 2236 bp, Homo sapiens
ttactgtaccgccgtgtgcattccctcatacggtcaggagttatgactcattttgaagatatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaatt

SEQ ID NO: 4645 - DNA, 554 bp, Homo sapiens
gtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacgatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtg

SEQ ID NO: 4646 - DNA, 576 bp, Homo sapiens
gaggtggaatttcatttcttccactaaagcgtttgcggagacttcaagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagct

SEQ ID NO: 4647 - DNA, 4061 bp, Homo sapiens
agttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttca

SEQ ID NO: 4648 - DNA, 3912 bp, Homo sapiens
cgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcg

SEQ ID NO: 4649 - DNA, 4148 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4650 - DNA, 3878 bp, Homo sapiens
gttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggagcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4651 - DNA, 4034 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4652 - DNA, 4305 bp, Homo sapiens
ctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 4653 - DNA, 3607 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtca

SEQ ID NO: 4654 - DNA, 3626 bp, Homo sapiens
gcgcagctctacatcaggggacaccgaggaggaggaggaggaggaggtggtgccattctcctcagatgaacagaaacggagtctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcac

SEQ ID NO: 4655 - DNA, 1599 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggacccagctgtacccactcagcaacctgcagatcccagtaccccagaacagcagaacagccccagcggatctga

SEQ ID NO: 4656 - DNA, 633 bp, Homo sapiens
gaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcag

SEQ ID NO: 4657 - DNA, 660 bp, Homo sapiens
tctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaaggg

SEQ ID NO: 4658 - DNA, 411 bp, Homo sapiens
cagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcaggtcttccccaggcaacaaagacaaggaggccccctgctccagagagctccagagggacttggctggtgaggaggctttcagggcccccaacacagatgctgcaagctccagtgccacttcagtctctgctgtccctgctgataggaagagcaacagcacagcagcccaggaggatgcaaaggcagacccaaaggg

SEQ ID NO: 4659 - DNA, 4328 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4660 - DNA, 3191 bp, Homo sapiens
aaagtgaaatggccgcccgggacgagctcggcctcggcggggattctcttgaggccatgcccgtgccggccgccagaggtcgcccgaggatcacgaatgggcccgaggagctggctgccccttcccccgcggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatca

SEQ ID NO: 4661 - DNA, 4235 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4662 - DNA, 4421 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4663 - DNA, 4334 bp, Homo sapiens
cagaagccctgctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtc

SEQ ID NO: 4664 - DNA, 5257 bp, Homo sapiens
ttgtatccatgtttttccgggcgtcccccggagggacaggttgcgggtgaccttttcaagtgtggaggaaagggaagctgcttttgtcttcaggaatgatgcaggtctcgactcaagcctgacgggcccaaacctccctggagctggctgacgactctgcccgagttcctgaagaggggtcccgggggtcccggagcggaagtgggagcgcgtgggcgtgggctcctcggctgcctggggctccagacttgtgctgcgtgcggctccggagctctgttctcgctcctgagcagctgctaggtttcccaagcgactgtctcaaccgcccggccgcctcccccgggcagccagagcttcacatctacctccagccgggacccgcccccgagccgcggggcccacgcccagagccctccgccgtccccagcgcagtgcagcagagcgcgatccagtctggggccgggccgcgcttccgcgcacgcgcggagaaacccgcgccctccgaggggggaggggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 4665 - DNA, 1346 bp, Homo sapiens
ttgtatccatgtttttccgggcgtcccccggagggacaggttgcgggtgaccttttcaagtgtggaggaaagggaagctgcttttgtcttcaggaatgatgcaggtctcgactcaagcctgacgggcccaaacctccctggagctggctgacgactctgcccgagttcctgaagaggggtcccgggggtcccggagcggaagtgggagcgcgtgggcgtgggctcctcggctgcctggggctccagacttgtgctgcgtgcggctccggagctctgttctcgctcctgagcagctgctaggtttcccaagcgactgtctcaaccgcccggccgcctcccccgggcagccagagcttcacatctacctccagccgggacccgcccccgagccgcggggcccacgcccagagccctccgccgtccccagcgcagtgcagcagagcgcgatccagtctggggccgggccgcgcttccgcgcacgcgcggagaaacccgcgccctccgaggggggaggggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagagatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaaggcaatccttaggtgtcacatggccctctag

SEQ ID NO: 4666 - DNA, 5259 bp, Homo sapiens
ttgtatccatgtttttccgggcgtcccccggagggacaggttgcgggtgaccttttcaagtgtggaggaaagggaagctgcttttgtcttcaggaatgatgcaggtctcgactcaagcctgacgggcccaaacctccctggagctggctgacgactctgcccgagttcctgaagaggggtcccgggggtcccggagcggaagtgggagcgcgtgggcgtgggctcctcggctgcctggggctccagacttgtgctgcgtgcggctccggagctctgttctcgctcctgagcagctgctaggtttcccaagcgactgtctcaaccgcccggccgcctcccccgggcagccagagcttcacatctacctccagccgggacccgcccccgagccgcggggcccacgcccagagccctccgccgtccccagcgcagtgcagcagagcgcgatccagtctggggccgggccgcgcttccgcgcacgcgcggagaaacccgcgccctccgaggggggaggggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaa

SEQ ID NO: 4667 - DNA, 1491 bp, Artificial Sequence
  Description of Artificial Sequence: Synthetic coding sequence
atgaccgtgttcctgagcttcgccttcctggccgccatcctgacccacatcggctgcagcaaccagcgccgcagccccgagaacagcggccgccgctacaaccgcatccagcacggccagtgcgcctacaccttcatcctgcccgagcacgacggcaactgccgcgagagcaccaccgaccagtacaacaccaacgccctgcagcgcgacgccccccacgtggagcccgacttcagcagccagaagctgcagcacctggagcacgtgatggagaactacacccagtggctgcagaagctggagaactacatcgtggagaacatgaagagcgagatggcccagatccagcagaacgccgtgcagaaccacaccgccaccatgctggagatcggcaccagcctgctgagccagaccgccgagcagacccgcaagctgaccgacgtggagacccaggtgctgaaccagaccagccgcctggagatccagctgctggagaacagcctgagcacctacaagctggagaagcagctgctgcagcagaccaacgagatcctgaagatccacgagaagaacagcctgctggagcacaagatcctggagatggagggcaagcacaaggaggagctggacaccctgaaggaggagaaggagaacctgcagggcctggtgacccgccagacctacatcatccaggagctggagaagcagctgaaccgcgccaccaccaacaacagcgtgctgcagaagcagcagctggagctgatggacaccgtgcacaacctggtgaacctgtgcaccaaggaggtgctgctgaagggcggcaagcgcgaggaggagaagcccttccgcgactgcgccgacgtgtaccaggccggcttcaacaagagcggcatctacaccatctacatcaacaacatgcccgagcccaagaaggtgttctgcaacatggacgtgaacggcggcggctggaccgtgatccagcaccgcgaggacggcagcctggacttccagcgcggctggaaggagtacaagatgggcttcggcaaccccagcggcgagtactggctgggcaacgagttcatcttcgccatcaccagccagcgccagtacatgctgcgcatcgagctgatggactgggagggcaaccgcgcctacagccagtacgaccgcttccacatcggcaacgagaagcagaactaccgcctgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgcgcagcaccaccatgatgatccgccccctggacttc

SEQ ID NO: 4668 - DNA, 1494 bp, Artificial Sequence
  Description of Artificial Sequence: Synthetic coding sequence
atgaccgtgttcctgagcttcgccttcctggccgccatcctgacccacatcggctgcagcaaccagcgccgcagccccgagaacagcggccgccgctacaaccgcatccagcacggccagtgcgcctacaccttcatcctgcccgagcacgacggcaactgccgcgagagcaccaccgaccagtacaacaccaacgccctgcagcgcgacgccccccacgtggagcccgacttcagcagccagaagctgcagcacctggagcacgtgatggagaactacacccagtggctgcagaagctggagaactacatcgtggagaacatgaagagcgagatggcccagatccagcagaacgccgtgcagaaccacaccgccaccatgctggagatcggcaccagcctgctgagccagaccgccgagcagacccgcaagctgaccgacgtggagacccaggtgctgaaccagaccagccgcctggagatccagctgctggagaacagcctgagcacctacaagctggagaagcagctgctgcagcagaccaacgagatcctgaagatccacgagaagaacagcctgctggagcacaagatcctggagatggagggcaagcacaaggaggagctggacaccctgaaggaggagaaggagaacctgcagggcctggtgacccgccagacctacatcatccaggagctggagaagcagctgaaccgcgccaccaccaacaacagcgtgctgcagaagcagcagctggagctgatggacaccgtgcacaacctggtgaacctgtgcaccaaggagggcgtgctgctgaagggcggcaagcgcgaggaggagaagcccttccgcgactgcgccgacgtgtaccaggccggcttcaacaagagcggcatctacaccatctacatcaacaacatgcccgagcccaagaaggtgttctgcaacatggacgtgaacggcggcggctggaccgtgatccagcaccgcgaggacggcagcctggacttccagcgcggctggaaggagtacaagatgggcttcggcaaccccagcggcgagtactggctgggcaacgagttcatcttcgccatcaccagccagcgccagtacatgctgcgcatcgagctgatggactgggagggcaaccgcgcctacagccagtacgaccgcttccacatcggcaacgagaagcagaactaccgcctgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgcgcagcaccaccatgatgatccgccccctggacttc

SEQ ID NO: 4669 - DNA, 891 bp, Artificial Sequence
  Description of Artificial Sequence: Synthetic coding sequence
atggagggcaagcacaaggaggagctggacaccctgaaggaggagaaggagaacctgcagggcctggtgacccgccagacctacatcatccaggagctggagaagcagctgaaccgcgccaccaccaacaacagcgtgctgcagaagcagcagctggagctgatggacaccgtgcacaacctggtgaacctgtgcaccaaggaggtgctgctgaagggcggcaagcgcgaggaggagaagcccttccgcgactgcgccgacgtgtaccaggccggcttcaacaagagcggcatctacaccatctacatcaacaacatgcccgagcccaagaaggtgttctgcaacatggacgtgaacggcggcggctggaccgtgatccagcaccgcgaggacggcagcctggacttccagcgcggctggaaggagtacaagatgggcttcggcaaccccagcggcgagtactggctgggcaacgagttcatcttcgccatcaccagccagcgccagtacatgctgcgcatcgagctgatggactgggagggcaaccgcgcctacagccagtacgaccgcttccacatcggcaacgagaagcagaactaccgcctgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgcgcagcaccaccatgatgatccgccccctggacttc

SEQ ID NO: 4670 - DNA, 894 bp, Artificial Sequence
  Description of Artificial Sequence: Synthetic coding sequence
atggagggcaagcacaaggaggagctggacaccctgaaggaggagaaggagaacctgcagggcctggtgacccgccagacctacatcatccaggagctggagaagcagctgaaccgcgccaccaccaacaacagcgtgctgcagaagcagcagctggagctgatggacaccgtgcacaacctggtgaacctgtgcaccaaggagggcgtgctgctgaagggcggcaagcgcgaggaggagaagcccttccgcgactgcgccgacgtgtaccaggccggcttcaacaagagcggcatctacaccatctacatcaacaacatgcccgagcccaagaaggtgttctgcaacatggacgtgaacggcggcggctggaccgtgatccagcaccgcgaggacggcagcctggacttccagcgcggctggaaggagtacaagatgggcttcggcaaccccagcggcgagtactggctgggcaacgagttcatcttcgccatcaccagccagcgccagtacatgctgcgcatcgagctgatggactgggagggcaaccgcgcctacagccagtacgaccgcttccacatcggcaacgagaagcagaactaccgcctgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgcgcagcaccaccatgatgatccgccccctggacttc

SEQ ID NO: 4671 - DNA, 1854 bp, Artificial Sequence
  Description of Artificial Sequence: Synthetic coding sequence
atgcacaagaccgccagccagcgcctgttccccggccccagctaccagaacatcaagagcatcatggaggacagcaccatcctgagcgactggaccaacagcaacaagcagaagatgaagtacgacttcagctgcgagctgtaccgcatgagcacctacagcaccttccccgccggcgtgcccgtgagcgagcgcagcctggcccgcgccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgcgcaacagcttcgcccacagcctgagccccaccctggagcacagcagcctgttcagcggcagctacagcagcctgagccccaaccccctgaacagccgcgccgtggaggacatcagcagcagccgcaccaacccctacagctacgccatgagcaccgaggaggcccgcttcctgacctaccacatgtggcccctgaccttcctgagccccagcgagctggcccgcgccggcttctactacatcggccccggcgaccgcgtggcctgcttcgcctgcggcggcaagctgagcaactgggagcccaaggacgacgccatgagcgagcaccgccgccacttccccaactgccccttcctggagaacagcctggagaccctgcgcttcagcatcagcaacctgagcatgcagacccacgccgcccgcatgcgcaccttcatgtactggcccagcagcgtgcccgtgcagcccgagcagctggccagcgccggcttctactacgtgggccgcaacgacgacgtgaagtgcttctgctgcgacggcggcctgcgctgctgggagagcggcgacgacccctgggtggagcacgccaagtggttcccccgctgcgagttcctgatccgcatgaagggccaggagttcgtggacgagatccagggccgctacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaaccgcgacctggtgaagcagaccgtgcagagcaagatcctgaccaccggcgagaactacaagaccgtgaacgacatcgtgagcgccctgctgaacgccgaggacgagaagcgcgaggaggagaaggagaagcaggccgaggagatggccagcgacgacctgagcctgatccgcaagaaccgcatggccctgttccagcagctgacctgcgtgctgcccatcctggacaacctgctgaaggccaacgtgatcaacaagcaggagcacgacatcatcaagcagaagacccagatccccctgcaggcccgcgagctgatcgacaccatcctggtgaagggcaacgccgccgccaacatcttcaagaactgcctgaaggagatcgacagcaccctgtacaagaacctgttcgtggacaagaacatgaagtacatccccaccgaggacgtgagcggcctgagcctggaggagcagctgcgccgcctgcaggaggagcgcacctgcaaggtgtgcatggacaaggaggtgagcgtggtgttcatcccctgcggccacctggtggtgtgccaggagtgcgcccccagcctgcgcaagtgccccatctgccgcggcatcatcaagggcaccgtgcgcaccttcctgagc

SEQ ID NO: 4672 - DNA, 1707 bp, Artificial Sequence
  Description of Artificial Sequence: Synthetic coding sequence
atgagcacctacagcaccttccccgccggcgtgcccgtgagcgagcgcagcctggcccgcgccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgcgcaacagcttcgcccacagcctgagccccaccctggagcacagcagcctgttcagcggcagctacagcagcctgagccccaaccccctgaacagccgcgccgtggaggacatcagcagcagccgcaccaacccctacagctacgccatgagcaccgaggaggcccgcttcctgacctaccacatgtggcccctgaccttcctgagccccagcgagctggcccgcgccggcttctactacatcggccccggcgaccgcgtggcctgcttcgcctgcggcggcaagctgagcaactgggagcccaaggacgacgccatgagcgagcaccgccgccacttccccaactgccccttcctggagaacagcctggagaccctgcgcttcagcatcagcaacctgagcatgcagacccacgccgcccgcatgcgcaccttcatgtactggcccagcagcgtgcccgtgcagcccgagcagctggccagcgccggcttctactacgtgggccgcaacgacgacgtgaagtgcttctgctgcgacggcggcctgcgctgctgggagagcggcgacgacccctgggtggagcacgccaagtggttcccccgctgcgagttcctgatccgcatgaagggccaggagttcgtggacgagatccagggccgctacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaaccgcgacctggtgaagcagaccgtgcagagcaagatcctgaccaccggcgagaactacaagaccgtgaacgacatcgtgagcgccctgctgaacgccgaggacgagaagcgcgaggaggagaaggagaagcaggccgaggagatggccagcgacgacctgagcctgatccgcaagaaccgcatggccctgttccagcagctgacctgcgtgctgcccatcctggacaacctgctgaaggccaacgtgatcaacaagcaggagcacgacatcatcaagcagaagacccagatccccctgcaggcccgcgagctgatcgacaccatcctggtgaagggcaacgccgccgccaacatcttcaagaactgcctgaaggagatcgacagcaccctgtacaagaacctgttcgtggacaagaacatgaagtacatccccaccgaggacgtgagcggcctgagcctggaggagcagctgcgccgcctgcaggaggagcgcacctgcaaggtgtgcatggacaaggaggtgagcgtggtgttcatcccctgcggccacctggtggtgtgccaggagtgcgcccccagcctgcgcaagtgccccatctgccgcggcatcatcaagggcaccgtgcgcaccttcctgagc

SEQ ID NO: 4673 - DNA, 1791 bp, Artificial Sequence
  Description of Artificial Sequence: Synthetic coding sequence
atggaggacagcaccatcctgagcgactggaccaacagcaacaagcagaagatgaagtacgacttcagctgcgagctgtaccgcatgagcacctacagcaccttccccgccggcgtgcccgtgagcgagcgcagcctggcccgcgccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgcgcaacagcttcgcccacagcctgagccccaccctggagcacagcagcctgttcagcggcagctacagcagcctgagccccaaccccctgaacagccgcgccgtggaggacatcagcagcagccgcaccaacccctacagctacgccatgagcaccgaggaggcccgcttcctgacctaccacatgtggcccctgaccttcctgagccccagcgagctggcccgcgccggcttctactacatcggccccggcgaccgcgtggcctgcttcgcctgcggcggcaagctgagcaactgggagcccaaggacgacgccatgagcgagcaccgccgccacttccccaactgccccttcctggagaacagcctggagaccctgcgcttcagcatcagcaacctgagcatgcagacccacgccgcccgcatgcgcaccttcatgtactggcccagcagcgtgcccgtgcagcccgagcagctggccagcgccggcttctactacgtgggccgcaacgacgacgtgaagtgcttctgctgcgacggcggcctgcgctgctgggagagcggcgacgacccctgggtggagcacgccaagtggttcccccgctgcgagttcctgatccgcatgaagggccaggagttcgtggacgagatccagggccgctacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaaccgcgacctggtgaagcagaccgtgcagagcaagatcctgaccaccggcgagaactacaagaccgtgaacgacatcgtgagcgccctgctgaacgccgaggacgagaagcgcgaggaggagaaggagaagcaggccgaggagatggccagcgacgacctgagcctgatccgcaagaaccgcatggccctgttccagcagctgacctgcgtgctgcccatcctggacaacctgctgaaggccaacgtgatcaacaagcaggagcacgacatcatcaagcagaagacccagatccccctgcaggcccgcgagctgatcgacaccatcctggtgaagggcaacgccgccgccaacatcttcaagaactgcctgaaggagatcgacagcaccctgtacaagaacctgttcgtggacaagaacatgaagtacatccccaccgaggacgtgagcggcctgagcctggaggagcagctgcgccgcctgcaggaggagcgcacctgcaaggtgtgcatggacaaggaggtgagcgtggtgttcatcccctgcggccacctggtggtgtgccaggagtgcgcccccagcctgcgcaagtgccccatctgccgcggcatcatcaagggcaccgtgcgcaccttcctgagc

SEQ ID NO: 4674 - DNA, 1812 bp, Artificial Sequence
  Description of Artificial Sequence: Synthetic coding sequence
atgaacatcgtggagaacagcatcttcctgagcaacctgatgaagagcgccaacaccttcgagctgaagtacgacctgagctgcgagctgtaccgcatgagcacctacagcaccttccccgccggcgtgcccgtgagcgagcgcagcctggcccgcgccggcttctactacaccggcgtgaacgacaaggtgaagtgcttctgctgcggcctgatgctggacaactggaagcgcggcgacagccccaccgagaagcacaagaagctgtaccccagctgccgcttcgtgcagagcctgaacagcgtgaacaacctggaggccaccagccagcccaccttccccagcagcgtgaccaacagcacccacagcctgctgcccggcaccgagaacagcggctacttccgcggcagctacagcaacagccccagcaaccccgtgaacagccgcgccaaccaggacttcagcgccctgatgcgcagcagctaccactgcgccatgaacaacgagaacgcccgcctgctgaccttccagacctggcccctgaccttcctgagccccaccgacctggccaaggccggcttctactacatcggccccggcgaccgcgtggcctgcttcgcctgcggcggcaagctgagcaactgggagcccaaggacaacgccatgagcgagcacctgcgccacttccccaagtgccccttcatcgagaaccagctgcaggacaccagccgctacaccgtgagcaacctgagcatgcagacccacgccgcccgcttcaagaccttcttcaactggcccagcagcgtgctggtgaaccccgagcagctggccagcgccggcttctactacgtgggcaacagcgacgacgtgaagtgcttctgctgcgacggcggcctgcgctgctgggagagcggcgacgacccctgggtgcagcacgccaagtggttcccccgctgcgagtacctgatccgcatcaagggccaggagttcatccgccaggtgcaggccagctacccccacctgctggagcagctgctgagcaccagcgacagccccggcgacgagaacgccgagagcagcatcatccacttcgagcccggcgaggaccacagcgaggacgccatcatgatgaacacccccgtgatcaacgccgccgtggagatgggcttcagccgcagcctggtgaagcagaccgtgcagcgcaagatcctggccaccggcgagaactaccgcctggtgaacgacctggtgctggacctgctgaacgccgaggacgagatccgcgaggaggagcgcgagcgcgccaccgaggagaaggagagcaacgacctgctgctgatccgcaagaaccgcatggccctgttccagcacctgacctgcgtgatccccatcctggacagcctgctgaccgccggcatcatcaacgagcaggagcacgacgtgatcaagcagaagacccagaccagcctgcaggcccgcgagctgatcgacaccatcctggtgaagggcaacatcgccgccaccgtgttccgcaacagcctgcaggaggccgaggccgtgctgtacgagcacctgttcgtgcagcaggacatcaagtacatccccaccgaggacgtgagcgacctgcccgtggaggagcagctgcgccgcctgcaggaggagcgcacctgcaaggtgtgcatggacaaggaggtgagcatcgtgttcatcccctgcggccacctggtggtgtgcaaggactgcgcccccagcctgcgcaagtgccccatctgccgcagcaccatcaagggcaccgtgcgcaccttcctgagc

SEQ ID NO: 4675 - DNA, 558 bp, Artificial Sequence
  Description of Artificial Sequence: Synthetic coding sequence
atgaagagcgacttctacttccagaagagcgagccccacagcctgagcagcgaggccctgatgcgccgcgccgtgagcctggtgaccgacagcaccagcaccttcctgagccagaccacctacgccctgatcgaggccatcaccgagtacaccaaggccgtgtacaccctgaccagcctgtaccgccagtacaccagcctgctgggcaagatgaacagcgaggaggaggacgaggtgtggcaggtgatcatcggcgcccgcgccgagatgaccagcaagcaccaggagtacctgaagctggagaccacctggatgaccgccgtgggcctgagcgagatggccgccgaggccgcctaccagaccggcgccgaccaggccagcatcaccgcccgcaaccacatccagctggtgaagctgcaggtggaggaggtgcaccagctgagccgcaaggccgagaccaagctggccgaggcccagatcgaggagctgcgccagaagacccaggaggagggcgaggagcgcgccgagagcgagcaggaggcctacctgcgcgaggac

SEQ ID NO: 4676 - DNA, 585 bp, Artificial Sequence
  Description of Artificial Sequence: Synthetic coding sequence
atggccgccctgaagagctggctgagccgcagcgtgaccagcttcttccgctaccgccagtgcctgtgcgtgcccgtggtggccaacttcaagaagcgctgcttcagcgagctgatccgcccctggcacaagaccgtgaccatcggcttcggcgtgaccctgtgcgccgtgcccatcgcccaggccgtgtacaccctgaccagcctgtaccgccagtacaccagcctgctgggcaagatgaacagcgaggaggaggacgaggtgtggcaggtgatcatcggcgcccgcgccgagatgaccagcaagcaccaggagtacctgaagctggagaccacctggatgaccgccgtgggcctgagcgagatggccgccgaggccgcctaccagaccggcgccgaccaggccagcatcaccgcccgcaaccacatccagctggtgaagctgcaggtggaggaggtgcaccagctgagccgcaaggccgagaccaagctggccgaggcccagatcgaggagctgcgccagaagacccaggaggagggcgaggagcgcgccgagagcgagcaggaggcctacctgcgcgaggac

SEQ ID NO: 4677 - DNA, 717 bp, Artificial Sequence
  Description of Artificial Sequence: Synthetic coding sequence
atggccgccctgaagagctggctgagccgcagcgtgaccagcttcttccgctaccgccagtgcctgtgcgtgcccgtggtggccaacttcaagaagcgctgcttcagcgagctgatccgcccctggcacaagaccgtgaccatcggcttcggcgtgaccctgtgcgccgtgcccatcgcccagaagagcgagccccacagcctgagcagcgaggccctgatgcgccgcgccgtgagcctggtgaccgacagcaccagcaccttcctgagccagaccacctacgccctgatcgaggccatcaccgagtacaccaaggccgtgtacaccctgaccagcctgtaccgccagtacaccagcctgctgggcaagatgaacagcgaggaggaggacgaggtgtggcaggtgatcatcggcgcccgcgccgagatgaccagcaagcaccaggagtacctgaagctggagaccacctggatgaccgccgtgggcctgagcgagatggccgccgaggccgcctaccagaccggcgccgaccaggccagcatcaccgcccgcaaccacatccagctggtgaagctgcaggtggaggaggtgcaccagctgagccgcaaggccgagaccaagctggccgaggcccagatcgaggagctgcgccagaagacccaggaggagggcgaggagcgcgccgagagcgagcaggaggcctacctgcgcgaggac

SEQ ID NO: 4678 - DNA, 582 bp, Artificial Sequence
  Description of Artificial Sequence: Synthetic coding sequence
atgcacaagtggatcctgacctggatcctgcccaccctgctgtaccgcagctgcttccacatcatctgcctggtgggcaccatcagcctggcctgcaacgacatgacccccgagcagatggccaccaacgtgaactgcagcagccccgagcgccacacccgcagctacgactacatggagggcggcgacatccgcgtgcgccgcctgttctgccgcacccagtggtacctgcgcatcgacaagcgcggcaaggtgaagggcacccaggagatgaagaacaactacaacatcatggagatccgcaccgtggccgtgggcatcgtggccatcaagggcgtggagagcgagttctacctggccatgaacaaggagggcaagctgtacgccaagaaggagtgcaacgaggactgcaacttcaaggagctgatcctggagaaccactacaacacctacgccagcgccaagtggacccacaacggcggcgagatgttcgtggccctgaaccagaagggcatccccgtgcgcggcaagaagaccaagaaggagcagaagaccgcccacttcctgcccatggccatcacc

SEQ ID NO: 4679 - DNA, 435 bp, Artificial Sequence
  Description of Artificial Sequence: Synthetic coding sequence
atggccacctgggccctgctgctgctggccgccatgctgctgggcaaccccggcctggtgttcagccgcctgagccccgagtactacgacctggcccgcgcccacctgcgcgacgaggagaagagctgcccctgcctggcccaggagggcccccagggcgacctgctgaccaagacccaggagctgggccgcgactaccgcacctgcctgaccatcgtgcagaagctgaagaagatggtggacaagcccacccagcgcagcgtgagcaacgccgccacccgcgtgtgccgcaccggccgcagccgctggcgcgacgtgtgccgcaacttcatgcgccgctaccagagccgcgtgacccagggcctggtggccggcgagaccgcccagcagatctgcgaggacctgcgcctgtgcatccccagcaccggccccctg

SEQ ID NO: 4680 - DNA, 390 bp, Artificial Sequence
  Description of Artificial Sequence: Synthetic coding sequence
atggagggcctggtgttcagccgcctgagccccgagtactacgacctggcccgcgcccacctgcgcgacgaggagaagagctgcccctgcctggcccaggagggcccccagggcgacctgctgaccaagacccaggagctgggccgcgactaccgcacctgcctgaccatcgtgcagaagctgaagaagatggtggacaagcccacccagcgcagcgtgagcaacgccgccacccgcgtgtgccgcaccggccgcagccgctggcgcgacgtgtgccgcaacttcatgcgccgctaccagagccgcgtgacccagggcctggtggccggcgagaccgcccagcagatctgcgaggacctgcgcctgtgcatccccagcaccggccccctg

SEQ ID NO: 4681 - DNA, 2478 bp, Artificial Sequence
  Description of Artificial Sequence: Synthetic coding sequence
atggagggcgccggcggcgccaacgacaagaagaagatcagcagcgagcgccgcaaggagaagagccgcgacgccgcccgcagccgccgcagcaaggagagcgaggtgttctacgagctggcccaccagctgcccctgccccacaacgtgagcagccacctggacaaggccagcgtgatgcgcctgaccatcagctacctgcgcgtgcgcaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgcgcgagatgctgacccaccgcaacggcctggtgaagaagggcaaggagcagaacacccagcgcagcttcttcctgcgcatgaagtgcaccctgaccagccgcggccgcaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagccgccacagcctggacatgaagttcagctactgcgacgagcgcatcaccgagctgatgggctacgagcccgaggagctgctgggccgcagcatctacgagtactaccacgccctggacagcgaccacctgaccaagacccaccacgacatgttcaccaagggccaggtgaccaccggccagtaccgcatgctggccaagcgcggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgcgcagcagcgccgaccccgccctgaaccaggaggtggccctgaagctggagcccaaccccgagagcctggagctgagcttcaccatgccccagatccaggaccagacccccagccccagcgacggcagcacccgccagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgcgcagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggaccgcatggaggacatcaagatcctgatcgccagccccagccccacccacatccacaaggagaccaccagcgccaccagcagcccctaccgcgacacccagagccgcaccgccagccccaaccgcgccggcaagggcgtgatcgagcagaccgagaagagccacccccgcagccccaacgtgctgagcgtggccctgagccagcgcaccaccgtgcccgaggaggagctgaaccccaagatcctggccctgcagaacgcccagcgcaagcgcaagatggagcacgacggcagcctgttccaggccgtgggcatcggcaccctgctgcagcagcccgacgaccacgccgccaccaccagcctgagctggaagcgcgtgaagggctgcaagagcagcgagcagaacggcatggagcagaagaccatcatcctgatccccagcgacctggcctgccgcctgctgggccagagcatggacgagagcggcctgccccagctgaccagctacgactgcgaggtgaacgcccccatccagggcagccgcaacctgctgcagggcgaggagctgctgcgcgccctggaccaggtgaac

SEQ ID NO: 4682 - DNA, 2481 bp, Artificial Sequence
  Description of Artificial Sequence: Synthetic coding sequence
atggagggcgccggcggcgccaacgacaagaagaaccgcatcagcagcgagcgccgcaaggagaagagccgcgacgccgcccgcagccgccgcagcaaggagagcgaggtgttctacgagctggcccaccagctgcccctgccccacaacgtgagcagccacctggacaaggccagcgtgatgcgcctgaccatcagctacctgcgcgtgcgcaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgcgcgagatgctgacccaccgcaacggcctggtgaagaagggcaaggagcagaacacccagcgcagcttcttcctgcgcatgaagtgcaccctgaccagccgcggccgcaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagccgccacagcctggacatgaagttcagctactgcgacgagcgcatcaccgagctgatgggctacgagcccgaggagctgctgggccgcagcatctacgagtactaccacgccctggacagcgaccacctgaccaagacccaccacgacatgttcaccaagggccaggtgaccaccggccagtaccgcatgctggccaagcgcggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgcgcagcagcgccgaccccgccctgaaccaggaggtggccctgaagctggagcccaaccccgagagcctggagctgagcttcaccatgccccagatccaggaccagacccccagccccagcgacggcagcacccgccagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgcgcagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggaccgcatggaggacatcaagatcctgatcgccagccccagccccacccacatccacaaggagaccaccagcgccaccagcagcccctaccgcgacacccagagccgcaccgccagccccaaccgcgccggcaagggcgtgatcgagcagaccgagaagagccacccccgcagccccaacgtgctgagcgtggccctgagccagcgcaccaccgtgcccgaggaggagctgaaccccaagatcctggccctgcagaacgcccagcgcaagcgcaagatggagcacgacggcagcctgttccaggccgtgggcatcggcaccctgctgcagcagcccgacgaccacgccgccaccaccagcctgagctggaagcgcgtgaagggctgcaagagcagcgagcagaacggcatggagcagaagaccatcatcctgatccccagcgacctggcctgccgcctgctgggccagagcatggacgagagcggcctgccccagctgaccagctacgactgcgaggtgaacgcccccatccagggcagccgcaacctgctgcagggcgaggagctgctgcgcgccctggaccaggtgaac

SEQ ID NO: 4683 - DNA, 2550 bp, Artificial Sequence
  Description of Artificial Sequence: Synthetic coding sequence
atgagcagccagtgccgcagcctggagaacaagttcgtgttcctgaaggagggcctgggcaacagcaagcccgaggagctggaggagatccgcatcgagaacggccgcatcagcagcgagcgccgcaaggagaagagccgcgacgccgcccgcagccgccgcagcaaggagagcgaggtgttctacgagctggcccaccagctgcccctgccccacaacgtgagcagccacctggacaaggccagcgtgatgcgcctgaccatcagctacctgcgcgtgcgcaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgcgcgagatgctgacccaccgcaacggcctggtgaagaagggcaaggagcagaacacccagcgcagcttcttcctgcgcatgaagtgcaccctgaccagccgcggccgcaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagccgccacagcctggacatgaagttcagctactgcgacgagcgcatcaccgagctgatgggctacgagcccgaggagctgctgggccgcagcatctacgagtactaccacgccctggacagcgaccacctgaccaagacccaccacgacatgttcaccaagggccaggtgaccaccggccagtaccgcatgctggccaagcgcggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgcgcagcagcgccgaccccgccctgaaccaggaggtggccctgaagctggagcccaaccccgagagcctggagctgagcttcaccatgccccagatccaggaccagacccccagccccagcgacggcagcacccgccagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgcgcagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggaccgcatggaggacatcaagatcctgatcgccagccccagccccacccacatccacaaggagaccaccagcgccaccagcagcccctaccgcgacacccagagccgcaccgccagccccaaccgcgccggcaagggcgtgatcgagcagaccgagaagagccacccccgcagccccaacgtgctgagcgtggccctgagccagcgcaccaccgtgcccgaggaggagctgaaccccaagatcctggccctgcagaacgcccagcgcaagcgcaagatggagcacgacggcagcctgttccaggccgtgggcatcggcaccctgctgcagcagcccgacgaccacgccgccaccaccagcctgagctggaagcgcgtgaagggctgcaagagcagcgagcagaacggcatggagcagaagaccatcatcctgatccccagcgacctggcctgccgcctgctgggccagagcatggacgagagcggcctgccccagctgaccagctacgactgcgaggtgaacgcccccatccagggcagccgcaacctgctgcagggcgaggagctgctgcgcgccctggaccaggtgaac

SEQ ID NO: 4684 - DNA, 2301 bp, Artificial Sequence
  Description of Artificial Sequence: Synthetic coding sequence
atgcgcctgaccatcagctacctgcgcgtgcgcaagctgctggacgccggcgacctggacatcgaggacgacatgaaggcccagatgaactgcttctacctgaaggccctggacggcttcgtgatggtgctgaccgacgacggcgacatgatctacatcagcgacaacgtgaacaagtacatgggcctgacccagttcgagctgaccggccacagcgtgttcgacttcacccacccctgcgaccacgaggagatgcgcgagatgctgacccaccgcaacggcctggtgaagaagggcaaggagcagaacacccagcgcagcttcttcctgcgcatgaagtgcaccctgaccagccgcggccgcaccatgaacatcaagagcgccacctggaaggtgctgcactgcaccggccacatccacgtgtacgacaccaacagcaaccagccccagtgcggctacaagaagccccccatgacctgcctggtgctgatctgcgagcccatcccccaccccagcaacatcgagatccccctggacagcaagaccttcctgagccgccacagcctggacatgaagttcagctactgcgacgagcgcatcaccgagctgatgggctacgagcccgaggagctgctgggccgcagcatctacgagtactaccacgccctggacagcgaccacctgaccaagacccaccacgacatgttcaccaagggccaggtgaccaccggccagtaccgcatgctggccaagcgcggcggctacgtgtgggtggagacccaggccaccgtgatctacaacaccaagaacagccagccccagtgcatcgtgtgcgtgaactacgtggtgagcggcatcatccagcacgacctgatcttcagcctgcagcagaccgagtgcgtgctgaagcccgtggagagcagcgacatgaagatgacccagctgttcaccaaggtggagagcgaggacaccagcagcctgttcgacaagctgaagaaggagcccgacgccctgaccctgctggcccccgccgccggcgacaccatcatcagcctggacttcggcagcaacgacaccgagaccgacgaccagcagctggaggaggtgcccctgtacaacgacgtgatgctgcccagccccaacgagaagctgcagaacatcaacctggccatgagccccctgcccaccgccgagacccccaagcccctgcgcagcagcgccgaccccgccctgaaccaggaggtggccctgaagctggagcccaaccccgagagcctggagctgagcttcaccatgccccagatccaggaccagacccccagccccagcgacggcagcacccgccagagcagccccgagcccaacagccccagcgagtactgcttctacgtggacagcgacatggtgaacgagttcaagctggagctggtggagaagctgttcgccgaggacaccgaggccaagaaccccttcagcacccaggacaccgacctggacctggagatgctggccccctacatccccatggacgacgacttccagctgcgcagcttcgaccagctgagccccctggagagcagcagcgccagccccgagagcgccagcccccagagcaccgtgaccgtgttccagcagacccagatccaggagcccaccgccaacgccaccaccaccaccgccaccaccgacgagctgaagaccgtgaccaaggaccgcatggaggacatcaagatcctgatcgccagccccagccccacccacatccacaaggagaccaccagcgccaccagcagcccctaccgcgacacccagagccgcaccgccagccccaaccgcgccggcaagggcgtgatcgagcagaccgagaagagccacccccgcagccccaacgtgctgagcgtggccctgagccagcgcaccaccgtgcccgaggaggagctgaaccccaagatcctggccctgcagaacgcccagcgcaagcgcaagatggagcacgacggcagcctgttccaggccgtgggcatcggcaccctgctgcagcagcccgacgaccacgccgccaccaccagcctgagctggaagcgcgtgaagggctgcaagagcagcgagcagaacggcatggagcagaagaccatcatcctgatccccagcgacctggcctgccgcctgctgggccagagcatggacgagagcggcctgccccagctgaccagctacgactgcgaggtgaacgcccccatccagggcagccgcaacctgctgcagggcgaggagctgctgcgcgccctggaccaggtgaac

SEQ ID NO: 4685 - DNA, 486 bp, Artificial Sequence
  Description of Artificial Sequence: Synthetic coding sequence
atgcgcatcagcaagccccacctgcgcagcatcagcatccagtgctacctgtgcctgctgctgaacagccacttcctgaccgaggccggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagc

SEQ ID NO: 4686 - DNA, 405 bp, Artificial Sequence
  Description of Artificial Sequence: Synthetic coding sequence
atggtgctgggcaccatcgacctgtgcagctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagc

SEQ ID NO: 4687 - DNA, 1377 bp, Artificial Sequence
  Description of Artificial Sequence: Synthetic coding sequence
atgatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 4688 - DNA, 1434 bp, Artificial Sequence
  Description of Artificial Sequence: Synthetic coding sequence
atggaccgcagcctgggctggcagggcaacagcgtgcccgaggaccgcaccgaggccggcatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 4689 - DNA, 1410 bp, Artificial Sequence
  Description of Artificial Sequence: Synthetic coding sequence
atgcccggcttctacagcgtgatgaccgacgaggagatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 4690 - DNA, 822 bp, Artificial Sequence
  Description of Artificial Sequence: Synthetic coding sequence
atgatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggctacggccccagcctgcgcctgctggccccccccggcgccgtgaagggcaccggccaggagcaccagggccagggctgccac

SEQ ID NO: 4691 - DNA, 1479 bp, Artificial Sequence
  Description of Artificial Sequence: Synthetic coding sequence
atgcgcagcagccccgccctgttcagcagccgcgccgccccccagaagccccgcaaggagggcagccaggccgccggcctgctggtgttcagcgacagcctggagatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 4692 - DNA, 939 bp, Artificial Sequence
  Description of Artificial Sequence: Synthetic coding sequence
atgaccggcaaggccaccccccccagcctgtacagctggcgcggcgtgctgttcacctgcctgcccgccgcccgcacccgcaagcgcaaggagatgagccgccagaccgccaccgccctgcccaccggcaccagcaagtgcccccccagccagcgcgtgcccgccctgaccggcaccaccgccagcaacaacgacctggccagcctgttcgagtgccccgtgtgcttcgactacgtgctgccccccatcctgcagtgccagagcggccacctggtgtgcagcaactgccgccccaagctgacctgctgccccacctgccgcggccccctgggcagcatccgcaacctggccatggagaaggtggccaacagcgtgctgttcccctgcaagtacgccagcagcggctgcgagatcaccctgccccacaccgagaaggccgaccacgaggagctgtgcgagttccgcccctacagctgcccctgccccggcgccagctgcaagtggcagggcagcctggacgccgtgatgccccacctgatgcaccagcacaagagcatcaccaccctgcagggcgaggacatcgtgttcctggccaccgacatcaacctgcccggcgccgtggactgggtgatgatgcagagctgcttcggcttccacttcatgctggtgctggagaagcaggagaagtacgacggccaccagcagttcttcgccatcgtgcagctgatcggcacccgcaagcaggccgagaacttcgcctaccgcctggagctgaacggccaccgccgccgcctgacctgggaggccaccccccgcagcatccacgagggcatcgccaccgccatcatgaacagcgactgcctggtgttcgacaccagcatcgcccagctgttcgccgagaacggcaacctgggcatcaacgtgaccatcagcatgtgc

SEQ ID NO: 4693 - DNA, 846 bp, Artificial Sequence
  Description of Artificial Sequence: Synthetic coding sequence
atgagccgccagaccgccaccgccctgcccaccggcaccagcaagtgcccccccagccagcgcgtgcccgccctgaccggcaccaccgccagcaacaacgacctggccagcctgttcgagtgccccgtgtgcttcgactacgtgctgccccccatcctgcagtgccagagcggccacctggtgtgcagcaactgccgccccaagctgacctgctgccccacctgccgcggccccctgggcagcatccgcaacctggccatggagaaggtggccaacagcgtgctgttcccctgcaagtacgccagcagcggctgcgagatcaccctgccccacaccgagaaggccgaccacgaggagctgtgcgagttccgcccctacagctgcccctgccccggcgccagctgcaagtggcagggcagcctggacgccgtgatgccccacctgatgcaccagcacaagagcatcaccaccctgcagggcgaggacatcgtgttcctggccaccgacatcaacctgcccggcgccgtggactgggtgatgatgcagagctgcttcggcttccacttcatgctggtgctggagaagcaggagaagtacgacggccaccagcagttcttcgccatcgtgcagctgatcggcacccgcaagcaggccgagaacttcgcctaccgcctggagctgaacggccaccgccgccgcctgacctgggaggccaccccccgcagcatccacgagggcatcgccaccgccatcatgaacagcgactgcctggtgttcgacaccagcatcgcccagctgttcgccgagaacggcaacctgggcatcaacgtgaccatcagcatgtgc

SEQ ID NO: 4694 - DNA, 1395 bp, Artificial Sequence
  Description of Artificial Sequence: Synthetic coding sequence
atgggcggcgccgtggtggacgagggccccaccggcgtgaaggcccccgacggcggctggggctgggccgtgctgttcggctgcttcgtgatcaccggcttcagctacgccttccccaaggccgtgagcgtgttcttcaaggagctgatccaggagttcggcatcggctacagcgacaccgcctggatcagcagcatcctgctggccatgctgtacggcaccggccccctgtgcagcgtgtgcgtgaaccgcttcggctgccgccccgtgatgctggtgggcggcctgttcgccagcctgggcatggtggccgccagcttctgccgcagcatcatccaggtgtacctgaccaccggcgtgatcaccggcctgggcctggccctgaacttccagcccagcctgatcatgctgaaccgctacttcagcaagcgccgccccatggccaacggcctggccgccgccggcagccccgtgttcctgtgcgccctgagccccctgggccagctgctgcaggaccgctacggctggcgcggcggcttcctgatcctgggcggcctgctgctgaactgctgcgtgtgcgccgccctgatgcgccccctggtggtgaccgcccagcccggcagcggccccccccgccccagccgccgcctgctggacctgagcgtgttccgcgaccgcggcttcgtgctgtacgccgtggccgccagcgtgatggtgctgggcctgttcgtgccccccgtgttcgtggtgagctacgccaaggacctgggcgtgcccgacaccaaggccgccttcctgctgaccatcctgggcttcatcgacatcttcgcccgccccgccgccggcttcgtggccggcctgggcaaggtgcgcccctacagcgtgtacctgttcagcttcagcatgttcttcaacggcctggccgacctggccggcagcaccgccggcgactacggcggcctggtggtgttctgcatcttcttcggcatcagctacggcatggtgggcgccctgcagttcgaggtgctgatggccatcgtgggcacccacaagttcagcagcgccatcggcctggtgctgctgatggaggccgtggccgtgctggtgggcccccccagcggcggcaagctgctggacgccacccacgtgtacatgtacgtgttcatcctggccggcgccgaggtgctgaccagcagcctgatcctgctgctgggcaacttcttctgcatccgcaagaagcccaaggagccccagcccgaggtggccgccgccgaggaggagaagctgcacaagccccccgccgacagcggcgtggacctgcgcgaggtggagcacttcctgaaggccgagcccgagaagaacggcgaggtggtgcacacccccgagaccagcgtg

SEQ ID NO: 4695 - DNA, 702 bp, Artificial Sequence
  Description of Artificial Sequence: Synthetic coding sequence
atggagcccagcagcaagaagctgaccggccgcctgatgctggccgtgggcggcgccgtgctgggcagcctgcagttcggctacaacaccggcgtgatcaacgccccccagaaggtgatcgaggagttctacaaccagacctgggtgcaccgctacggcgagagcatcctgcccaccaccctgaccaccctgtggagcctgagcgtggccatcttcagcgtgggcggcatgatcggcagcttcagcgtgggcctgttcgtgaaccgcttcggccgccgcaacagcatgctgatgatgaacctgctggccttcgtgagcgccgtgctgatgggcttcagcaagctgggcaagagcttcgagatgctgatcctgggccgcttcatcatcggcgtgtactgcggcctgaccaccggcttcgtgcccatgtacgtgggcgaggtgagccccaccgccctgcgcggcgccctgggcaccctgcaccagctgggcatcgtggtgggcatcctgatcgcccaggtgagctggggccgcatctacctgcccggcaccgcccccgcccacagcttcagcggcagccgcatctgcgcccagcagggccgcgtgagcctgccccccagcccccacagcctggccgaggacaactacggcacccaggtgcagcgcacccagcaccacggcctgcccgtggacagcaagatgacc

SEQ ID NO: 4696 - DNA, 525 bp, Artificial Sequence
  Description of Artificial Sequence: Synthetic coding sequence
atggagcccagcagcaagaagctgaccggccgcctgatgctggccgtgggcggcgccgtgctgggcagcctgcagttcggctacaacaccggcgtgatcaacgccccccagaaggtgatcgaggagttctacaaccagacctgggtgcaccgctacggcgagagcatcctgcccaccaccctgaccaccctgtggagcctgagcgtggccatcttcagcgtgggcggcatgatcggcagcttcagcgtgggcctgttcgtgaaccgcttcggccgccgcaacagcatgctgatgatgaacctgctggccttcgtgagcgccgtgctgatgggcttcagcaagctgggcaaccccaagctggagaccaccgacacccccctgcccaagaagttccccttccgcccccaggcccgcaaggtgaccgccgtgcagtgccccttctgcctgagcatctgccccctgcacagcctgctgatcctgggccccaccagcaccgccaccgaggccggcaagggccacaacgtg

SEQ ID NO: 4697 - DNA, 1476 bp, Artificial Sequence
  Description of Artificial Sequence: Synthetic coding sequence
atggagcccagcagcaagaagctgaccggccgcctgatgctggccgtgggcggcgccgtgctgggcagcctgcagttcggctacaacaccggcgtgatcaacgccccccagaaggtgatcgaggagttctacaaccagacctgggtgcaccgctacggcgagagcatcctgcccaccaccctgaccaccctgtggagcctgagcgtggccatcttcagcgtgggcggcatgatcggcagcttcagcgtgggcctgttcgtgaaccgcttcggccgccgcaacagcatgctgatgatgaacctgctggccttcgtgagcgccgtgctgatgggcttcagcaagctgggcaagagcttcgagatgctgatcctgggccgcttcatcatcggcgtgtactgcggcctgaccaccggcttcgtgcccatgtacgtgggcgaggtgagccccaccgccctgcgcggcgccctgggcaccctgcaccagctgggcatcgtggtgggcatcctgatcgcccaggtgttcggcctggacagcatcatgggcaacaaggacctgtggcccctgctgctgagcatcatcttcatccccgccctgctgcagtgcatcgtgctgcccttctgccccgagagcccccgcttcctgctgatcaaccgcaacgaggagaaccgcgccaagagcgtgctgaagaagctgcgcggcaccgccgacgtgacccacgacctgcaggagatgaaggaggagagccgccagatgatgcgcgagaagaaggtgaccatcctggagctgttccgcagccccgcctaccgccagcccatcctgatcgccgtggtgctgcagctgagccagcagctgagcggcatcaacgccgtgttctactacagcaccagcatcttcgagaaggccggcgtgcagcagcccgtgtacgccaccatcggcagcggcatcgtgaacaccgccttcaccgtggtgagcctgttcgtggtggagcgcgccggccgccgcaccctgcacctgatcggcctggccggcatggccggctgcgccatcctgatgaccatcgccctggccctgctggagcagctgccctggatgagctacctgagcatcgtggccatcttcggcttcgtggccttcttcgaggtgggccccggccccatcccctggttcatcgtggccgagctgttcagccagggcccccgccccgccgccatcgccgtggccggcttcagcaactggaccagcaacttcatcgtgggcatgtgcttccagtacgtggagcagctgtgcggcccctacgtgttcatcatcttcaccgtgctgctggtgctgttcttcatcttcacctacttcaaggtgcccgagaccaagggccgcaccttcgacgagatcgccagcggcttccgccagggcggcgccagccagagcgacaagacccccgaggagctgttccaccccctgggcgccgacagccaggtg

SEQ ID NO: 4698 - DNA, 750 bp, Artificial Sequence
  Description of Artificial Sequence: Synthetic coding sequence
atgctgatgatgaacctgctggccttcgtgagcgccgtgctgatgggcttcagcaagctgggcaagagcttcgagatgctgatcctgggccgcttcatcatcggcgtgtactgcggcctgaccaccggcttcgtgcccatgtacgtgggcgaggtgagccccaccgccctgcgcggcgccctgggcaccctgcaccagctgggcatcgtggtgggcatcctgatcgcccaggtgttcggcctggacagcatcatgggcaacaaggacctgtggcccctgctgctgagcatcatcttcatccccgccctgctgcagtgcatcgtgctgcccttctgccccgagagcccccgcttcctgctgatcaaccgcaacgaggagaaccgcgccaagagcgtgctgaagaagctgcgcggcaccgccgacgtgacccacgacctgcaggagatgaaggaggagagccgccagatgatgcgcgagaagaaggtgaccatcctggagctgttccgcagccccgcctaccgccagcccatcctgatcgccgtggtgctgcagctgagccagcagctgagcggcatcaacgccgtgttctactacagcaccagcatcttcgagaaggccggcgtgcagcagcccgtgtacgccaccatcggcagcggcatcgtgaacaccgccttcaccgtggtgagcgtgagcctgtgcctgctggccccccccgccaagccccagggcggcggcagcgccatcttcccc

SEQ ID NO: 4699 - DNA, 1491 bp, Artificial Sequence
  Description of Artificial Sequence: Synthetic coding sequence
atgaccttcaacagcttcgagggcagcaagacctgcgtgcccgccgacatcaacaaggaggaggagttcgtggaggagttcaaccgcctgaagaccttcgccaacttccccagcggcagccccgtgagcgccagcaccctggcccgcgccggcttcctgtacaccggcgagggcgacaccgtgcgctgcttcagctgccacgccgccgtggaccgctggcagtacggcgacagcgccgtgggccgccaccgcaaggtgagccccaactgccgcttcatcaacggcttctacctggagaacagcgccacccagagcaccaacagcggcatccagaacggccagtacaaggtggagaactacctgggcagccgcgaccacttcgccctggaccgccccagcgagacccacgccgactacctgctgcgcaccggccaggtggtggacatcagcgacaccatctacccccgcaaccccgccatgtacagcgaggaggcccgcctgaagagcttccagaactggcccgactacgcccacctgaccccccgcgagctggccagcgccggcctgtactacaccggcatcggcgaccaggtgcagtgcttctgctgcggcggcaagctgaagaactgggagccctgcgaccgcgcctggagcgagcaccgccgccacttccccaactgcttcttcgtgctgggccgcaacctgaacatccgcagcgagagcgacgccgtgagcagcgaccgcaacttccccaacagcaccaacctgccccgcaaccccagcatggccgactacgaggcccgcatcttcaccttcggcacctggatctacagcgtgaacaaggagcagctggcccgcgccggcttctacgccctgggcgagggcgacaaggtgaagtgcttccactgcggcggcggcctgaccgactggaagcccagcgaggacccctgggagcagcacgccaagtggtaccccggctgcaagtacctgctggagcagaagggccaggagtacatcaacaacatccacctgacccacagcctggaggagtgcctggtgcgcaccaccgagaagacccccagcctgacccgccgcatcgacgacaccatcttccagaaccccatggtgcaggaggccatccgcatgggcttcagcttcaaggacatcaagaagatcatggaggagaagatccagatcagcggcagcaactacaagagcctggaggtgctggtggccgacctggtgaacgcccagaaggacagcatgcaggacgagagcagccagaccagcctgcagaaggagatcagcaccgaggagcagctgcgccgcctgcaggaggagaagctgtgcaagatctgcatggaccgcaacatcgccatcgtgttcgtgccctgcggccacctggtgacctgcaagcagtgcgccgaggccgtggacaagtgccccatgtgctacaccgtgatcaccttcaagcagaagatcttcatgagc

SEQ ID NO: 4700 - DNA, 48 bp, Artificial Sequence
  Description of Artificial Sequence: Synthetic coding sequence
atgaccttcaacagcttcgagggcagcaagacctgcgtgcccgccgac

SEQ ID NO: 4701 - DNA, 468 bp, Artificial Sequence
  Description of Artificial Sequence: Synthetic coding sequence
atgaccttcaacagcttcgagggcagcaagacctgcgtgcccgccgacatcaacaaggaggaggagttcgtggaggagttcaaccgcctgaagaccttcgccaacttccccagcggcagccccgtgagcgccagcaccctggcccgcgccggcttcctgtacaccggcgagggcgacaccgtgcgctgcttcagctgccacgccgccgtggaccgctggcagtacggcgacagcgccgtgggccgccaccgcaaggtgagccccaactgccgcttcatcaacggcttctacctggagaacagcgccacccagagcaccaacagcggcatccagaacggccagtacaaggtggagaactacctgggcagccgcgaccacttcgccctggaccgccccagcgagacccacgccgactacctgctgcgcaccggccaggtggtggacatcagcgacaccatctacccccgc

SEQ ID NO: 4702 - RNA, 4244 nt, Artificial Sequence
  Description of Artificial Sequence: Synthetic coding sequence
gggaaauaagagagaaaagaagaguaagaagaaauauaagagccaccaugcugucguucguggacacacgaacccuucugcuucucgcagugacuuugugucuugcgacaugucagucgcuccaagaagaaacggugcgaaaagggccugccggugacagggguccucggggagaaagagguccaccaggcccuccgggaagggauggggaagaugggcccacuggaccacccgguccgccuggaccuccggguccgccugguuuggguggcaacuuugcggcacaauaugaugggaagggagugggacuugguccagggccgaugggacuuaugggaccccgagguccgccaggggcugcgggagccccagggccacaggguuuucaaggaccggcaggggagcccggugagcccggacagaccgggccggcgggugcuaggggaccagcugggccucccggaaaggcuggugaagauggucauccggguaaaccuggccgacccggugaacgcggagucgucggaccucagggcgcacggggauuccccggaacacccggguugccugguuucaagggaauucgaggccacaauggacuggacgggcugaagggucagccgggagcgccaggugucaagggcgaaccaggggcuccgggagagaacggcacaccgggucagacuggugccagaggguugccaggggaacggggaagggugggugcgccugggccagcgggugcacgcggaagcgaugggucgguagggccugucggcccagcggguccgauuggguccgcugguccgccuggguuuccgggugccccugggcccaagggcgagaucggggcaguggggaaugcgggaccugccggacccgcagggccgaggggcgagguggggcugcccgguuuguccggaccgguaggaccaccagggaacccgggagcaaacggucugacgggugccaagggugcagcggguuugccgggaguagccggugcgccagggcuuccgggacccagagguauccccggacccgugggggcugcaggggccacgggagcaagaggccucgucggggagccggguccugcuggcucaaaaggggaaucagggaauaagggugagccuggcucagcagguccccaagguccgccuggcccaucgggagaagaggggaagaggggucccaauggagaagcggggucagcgggaccaccugggccaccaggauugcgagguagcccugguucacggggacucccuggagcggacggucgggcuggaguaauggggccacccgggucgagaggcgcgucagguccugccggagucaggggacccaauggugacgccggacggccaggugaaccgggacucauggguccgaggggauugccuggaucaccgggcaacaucgggccugccgguaaagagggaccggugggacuucccggaauugacgguagaccagggcccauugggccugcuggggcacggggagagcccggaaacaucggguuuccaggccccaaaggaccuacuggggacccuggcaagaauggagacaaaggucacgcagggcuggcgggagccagaggggcaccgggacccgacggaaacaacggggcacaaggaccgccagguccucaaggggugcagggcggaaagggugaacaggguccgccaggcccaccugguuuucagggucugccaggucccucgggaccggcaggagagguggggaagccaggcgaaagagggcugcacggagaguucggacuccccggucccgcggggcccagaggcgaacggggaccaccgggagagucgggagcggcagggccuacgggacccaucggaucgagaggaccguccgguccuccgggaccggauggaaacaagggagaacccggaguggugggagcagucggaacugcgggaccaagcgguccaucggggcucccuggugagaggggagcugcgggaaucccagggggcaaaggcgagaagggcgagccaggacucaggggagaaauugggaauccuggcagggacggagcgaggggagcaccgggagcggucggugcaccugguccagccggagcgacgggggauaggggagaagcaggggcagccggaccggcugggccugccgguccacgagggucacccggagaacggggagaagucggaccagcagguccgaacggguucgcggguccagcaggugcugcgggacagccgggugcgaaaggggagcgcggagcaaagggucccaagggggaaaacggugucgucgguccgacagguccgguaggggcagcagggccagcuggaccuaaugguccucccggaccagccggaucaagaggugauggcggaccaccgggaaugacaggguuccccggugcagccggucgcaccggaccaccagguccgucgggaauuuccggucccccuggcccacccggaccggcugggaaagaggggcugagagggccuagaggggaucagggacccgucggaagaacgggggaagugggugcggucgggccaccgggauucgcuggggaaaaagggcccucgggcgaggccggaaccgcagguccacccgguacaccgggaccgcagggucuguugggagcacccggcauccuuggucugcccgguagcagaggcgagagaggacugccuggagucgcgggagccgugggggagccuggaccguuggggaucgccggacccccuggggcgaggggaccgccuggugccgucgguucgccuggugucaauggagcaccuggugaggcuggacgggacgguaaucccggaaacgaugguccaccgggacgagaugggcagccuggacacaagggugagagagguuauccggggaacauuggucccgucggugcggcaggagcaccagggccucacgggccagucgggccagccggaaagcacgggaaucgaggcgagacuggaccuuccgguccgguggggccagcgggagcuguaggaccaagggguccuagcggaccacagggcauucgaggggacaaaggugaacccggugagaaaggaccgagagggcuccccggacugaagggacacaacggacuccagggguugccgggaaucgcagggcaucauggcgaucagggagcgccuggaucggucggaccggcagguccgcgaggacccgcugggccuucgggaccagcggggaaagauggaaggacgggucaucccgggacagucgguccugccggcauccgcggaccccagggucaucaggguccagcgggacccccugguccaccuggcccaccaggaccucccggagugucggguggcggguacgauuuugguuaugacggagacuucuauagggcggaucagccccgaucagcgccgucgcuucggccuaaagacuaugagguggaugcaacucucaagucgcucaacaaucagauugaaacgcugcuuacgcccgaaggcucacgcaagaauccagcuagaacuugucgggaucugagacucucacacccagaguggucguccggcuauuacuggaucgaccccaaucagggauguaccauggacgccaucaaaguguacugcgacuuuucgacgggugagacuugcaucagggcucagcccgagaauaucccagcgaagaacugguaucgguccagcaaagacaagaagcacgugugguugggggaaaccaucaacgccggaagccaguuugaguacaauguagagggggugacgucgaaagagauggcaacgcaacuggccuucaugaggcucuuggcgaauuacgcgucacagaacaucacauaccauugcaaaaacagcauugcguacauggacgaagagacagggaauuugaaaaaggccguaaucuugcaagggucgaacgacguggaacuuguagcggaagguaacucgcgcuucacauacacgguguugguggauggaugcuccaaaaagacaaacgaauggggaaagacgaucaucgaauacaaaaccaacaaacccucacgacucccuuucuuggauaucgcgccucuugacauugguggagccgaccaggaauucuuuguggauauuggcccaguaugcuucaaaugauaagcugccuucugcggggcuugccuucuggccaugcccuucuucucucccuugcaccuguaccucuuggucuuugaauaaagccugaguaggaag

SEQ ID NO: 4703 - RNA, 1613 nt, Artificial Sequence
  Description of Artificial Sequence: Synthetic coding sequence
gggaaauaagagagaaaagaagaguaagaagaaauauaagagccaccauggccccugucgcggugugggcggcucuugcgguaggccucgaacucugggcggcagcucacgcccugccagcccaagucgccuucacgccuuacgcgccagaacccgggucaacuugucgccuuagggaguauuaugaccaaacggcucagauguguugcagcaaaugcucgccagggcagcacgcaaaaguguuuuguacuaagacguccgauacgguaugugauucaugugaggacuccaccuacacucagcuuuggaauugggugcccgagugccugucaugcgggucgcgcugcucgucggaucagguagaaacucaagcgugcacucgagaacagaacagaauuuguacgugcaggcccgguugguacugcgccuugucgaagcaggaaggcugcaggcuuugugcgccgcuucgcaaguguaggccuggauuuggagucgcgaggccgggaaccgagacauccgacguagucuguaagcccugugcuccgggaacguucuccaacacaacuucgagcacggacaucugucggccccaccagauuugcaauguaguggcaauccccgggaacgcgucaauggacgccgucuguacguccaccucgcccacuagauccauggcaccgggagcagugcauuugccgcagcccgugucgacgcgaucacagcacacacagcccacaccagagccuucgacagcgccgucgacaucauucuugcugccgauggggccgucgccgccugccgagggcucaacuggugaugagccgaaaagcugcgacaaaacgcauacauguccgcccugccccgcucccgaacuccucggugggccuagcguguuucuguucccaccaaaaccgaaagauaccuugaugaucucacggaccccugaagugacgugcguggucgucgaugucucgcaugaggaccccgaggugaaguuuaacugguacgucgacggaguggaagugcacaaugccaagaccaagcccagagaggaacaguacaacuccacuuacagagucgugucgguacucacugucuugcaucaggauuggcugaacggaaaggaguauaagugcaaaguaucgaacaaagcgcugccagcgccgaucgagaaaacaaucagcaaagcgaagggacagccucgcgaaccucaaguguauacguugccgcccucacgagaggaaaugacgaagaaucaggucagccucacgugcuuggugaaaggcuucuauccgagcgauauugccguggagugggaguccaauggucagccagagaacaauuacaagacgacaccgccugucuuggauucggacgggagcuuuuucuuguacucgaaacucacgguagacaagagcagauggcaacaggggaauguauucucguguucagugaugcacgaggcgcuccacaaccauuauacacaaaagucgcucucguugucaccgggaaagugauaagcugccuucugcggggcuugccuucuggccaugcccuucuucucucccuugcaccuguaccucuuggucuuugaauaaagccugaguaggaag

SEQ ID NO: 4704 - protein, 888 aa, Homo sapiens [sequence omitted]

SEQ ID NO: 4705 - protein, 835 aa, Homo sapiens
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLLGGGASSRVLADGMTRGPVVRLPRACDSAEVKAWLETSEGFAVIKEAFDSTSRFARLQKLHTSIAGRNLYIRFQSRSGDAMGMNMISKGTEKALSKLHEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACKDNPGENARQLARIVCGTVMAGELSLMAALAAGHLVKSHMIHNRSKINLQDLQGACTKKTA

SEQ ID NO: 4706 - protein, 265 aa, Homo sapiens
MLSRLFRMHGLFVASHPWEVIVGTVTLTICMMSMNMFTEGTEKALSKLHEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACKDNPGENARQLARIVCGTVMAGELSLMAALAAGHLVKSHMIHNRSKINLQDLQGACTKKTA

SEQ ID NO: 4707 - protein, 18 aa, Homo sapiens
MLSRLFRMHGLFVASHPW

SEQ ID NO: 4708 - protein, 111 aa, Homo sapiens
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVI

SEQ ID NO: 4709 - protein, 888 aa, Homo sapiens [sequence omitted]

SEQ ID NO: 4710 - protein, 819 aa, Homo sapiens
MHSHPVYLLPVPEFTSTWIKIYFGYCWPFHNFLKFCIQYSCHSLLRQRIDRLEEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLVMGACCENVIGYMPIPVGVAGPLCLDEKEFQVPMATTEGCLVASTNRGCRAIGLGGGASSRVLADGMTRGPVVRLPRACDSAEVKAWLETSEGFAVIKEAFDSTSRFARLQKLHTSIAGRNLYIRFQSRSGDAMGMNMISKGTEKALSKLHEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACKDNPGENARQLARIVCGTVMAGELSLMAALAAGHLVKSHMIHNRSKINLQDLQGACTKKTA

SEQ ID NO: 4711 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 4712 - protein, 532 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQGVSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 4713 - protein, 492 aa, Homo sapiens
RAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPCLTGRII

SEQ ID NO: 4714 - protein, 429 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYATRANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 4715 - protein, 1706 aa, Homo sapiens
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSDDFLADQAACYVQAIQWILHYYYHGVQSWSWYYPYHYAPFLSDIHNISTLKIHFELGKPFKPFEQLLAVLPAASKNLLPACYQHLMTNEDSPIIEYYPPDFKTDLNGKQQEWEAVVLIPFIDEKRLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTGWDHYGSNYALGAANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 4716 - protein, 1694 aa, Homo sapiens
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSDDFLADQAACYVQAIQWILHYYYHGVQSWSWYYPYHYAPFLSDIHNISTLKIHFELGKPFKPFEQLLAVLPAASKNLLPACYQHLMTNEDSPIIEYYPPDFKTDLNGKQQEWEAVVLIPFIDEKRLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 4717 - protein, 459 aa, Homo sapiens
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSEYVFANAFILK

SEQ ID NO: 4718 - protein, 249 aa, Homo sapiens
MLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSEYVFANAFILK

SEQ ID NO: 4719 - protein, 1160 aa, Homo sapiens
  MOD_RES (1)..(1): Any amino acid
XTNEDSPIIEYYPPDFKTDLNGKQQEWEAVVLIPFIDERLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 4720 - protein, 410 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQATPPSYRCCSVPTCANPAMLRSHQQSAERVPKGRKARWGTLDKEIPQAPSPPFPTSLSPSPPSLMLGRGLPVTTSKARHPQIKQSVCTTRWGGGY

SEQ ID NO: 4721 - protein, 356 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQALCQVITTFMTFLGPHRLDQMPPEELQTSSSRLGGPPWQCI

SEQ ID NO: 4722 - protein, 424 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 4723 - protein, 324 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVSVPRCPP

SEQ ID NO: 4724 - protein, 197 aa, Homo sapiens
MVERLCQAFGPRLIQLDDVTYHGFPSLQALAGPEVEAHLRKLGLGYRARYVSASARAILEEQGGLAWLQQLRESSYEEAHKALCILPGVGTKETFSGACGDLMLAGPKRCCSVPTCANPAMLRSHQQSAERVPKGRKARWGTLDKEIPQAPSPPFPTSLSPSPPSLMLGRGLPVTTSKARHPQIKQSVCTTRWGGGY

SEQ ID NO: 4725 - protein, 345 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVLFSADLRQSRHAQEPPAKRRKGSKGPEG

SEQ ID NO: 4726 - protein, 357 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 4727 - protein, 195 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPPWQCI

SEQ ID NO: 4728 - protein, 322 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAAGSDAS

SEQ ID NO: 4729 - protein, 2268 aa, Homo sapiens
MSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4730 - protein, 2383 aa, Homo sapiens
MWWSTLMSILRARSFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4731 - protein, 2288 aa, Homo sapiens
MEGSPEENKEMRYYMLQRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4732 - protein, 472 aa, Homo sapiens [sequence omitted]

SEQ ID NO: 4733 - protein, 42 aa, Homo sapiens
MSGLHLVKQGRDRKKIDSQRDFTVASPAEFVTRFGGNKVIEK

SEQ ID NO: 4734 - protein, 2346 aa, Homo sapiens
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4735 - protein, 42 aa, Homo sapiens; identical to SEQ ID NO: 4733

SEQ ID NO: 4736 - protein, 77 aa, Homo sapiens
MDEPSPLAQPLELNQHSRFIIGSVSEDNSEDEISNLVKLDLLEEKEGSLSPASVGSDTLSDLGISSLQDGLALHIRL

SEQ ID NO: 4737 - protein, 1045 aa, Homo sapiens
MGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4738 - protein, 120 aa, Homo sapiens
MDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEK

SEQ ID NO: 4739 - protein, 2370 aa, Homo sapiens
SFWKWISTQTVRIIRAVRAHFGGIMDEPSPLAQPLELNQHSRFIIGSVSEDNSEDEISNLVKLDLLEEKEGSLSPASVGSDTLSDLGISSLQDGLALHIRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQVQAEVPGSPIFVMRLAKQSRHLEVQILADQYGNAISLFGRDCSVQRRHQKIIEEAPATIATPAVFEHMEQCAVKLAKMVGYVSAGTVEYLYSQDGSFYFLELNPRLQVEHPCTEMVADVNLPAAQLQIAMGIPLYRIKDIRMMYGVSPWGDSPIDFEDSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQMNRIDTGWLDRLIAEKVQAERPDTMLGVVCGALHVADVSLRNSVSNFLHSLERGQVLPAHTLLNTVDVELIYEGVKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVLAKMQLDNPSKVQQAELHTGSLPRIQSTALRGEKLHRVFHYVLDNLVNVMNGYCLPDPFFSSKVKDWVERLMKTLRDPSLPLLELQDIMTSVSGRIPPNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYELRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFSSNLNHYGMTHVASVSDVLLDNSFTPPCQRMGGMVSFRTFEDFVRIFDEVMGCFSDSPPQSPTFPEAGHTSLYDEDKVPRDEPIHILNVAIKTDCDIEDDRLAAMFREFTQQNKATLVDHGIRRLTFLVAQKDFRKQVNYEVDRRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTPTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDMLTYTELVLDDQGQLVHMNRLPGGNEIGMVAWKMTFKSPEYPEGRDIIVIGNDITYRIGSFGPQEDLLFLRASELARAEGIPRIYVSANSGARIGLAEEIRHMFHVAWVDPEDPYKGYRYLYLTPQDYKRVSALNSVHCEHVEDEGESRYKITDIIGKEEGIGPENLRGSGMIAGESSLAYNEIITISLVTCRAIGIGAYLVRLGQRTIQVENSHLILTGAGALNKVLGREVYTSNNQLGGIQIMHNNGVTHCTVCDDFEGVFTVLHWLSYMPKSVHSSVPLLNSKDPIDRIIEFVPTKTPYDPRWMLAGRPHPTQKGQWLSGFFDYGSFSEIMQPWAQTVVVGRARLGGIPVGVVAVETRTVELSIPADPANLDSEAKIIQQAGQVWFPDSAFKTYQAIKDFNREGLPLMVFANWRGFSGGMKDMYDQVLKFGAYIVDGLRECCQPVLVYIPPQAELRGGSWVVIDSSINPRHMEMYADRESRGSVLEPEGTVEIKFRRKDLVKTMRRVDPVYIHLAERLGTPELSTAERKELENKLKEREEFLIPIYHQVAVQFADLHDTPGRMQEKGVISDILDWKTSRTFFYWRLRRLLLEDLVKKKIHNANPELTDGQIQAMLRRWFVEVEGTVKAYVWDNNKDLAEWLEKQLTEEDGVHSVIEENIKCISRDYVLKQIRSLVQANPEVAMDSIIHMTQHISPTQRAEVIRILSTMDSPST

SEQ ID NO: 4740 - protein, 258 aa, Homo sapiens
MSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGPNNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQELYEKGYVKDVDDGLQAAEEVGYPVMIKASEGGGGKGIRKVNNADDFPNLFRQ

SEQ ID NO: 4741 - protein, 47 aa, Homo sapiens
MDEPSPLAQPLELNQHSRFIIGSVSEDNSEDEISNLVKLDLLEEKEG

SEQ ID NO: 4742 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 4743 - protein, 914 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 4744 - protein, 887 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 4745 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 4746 - protein, 692 aa, Homo sapiens
MVDYHAANQSYQYGPSSAGNGAGGGGSMGDYMAQEDDWDRDLLLDPAWEKQQRKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 4747 - protein, 521 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVHELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 4748 - protein, 562 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTPDGLQEGPGQPHSPIPPLCIYAKHSLQSSGVGGWAGRGWGRLSPLSLCGLARRFPRPGWGDLGPALLVW

SEQ ID NO: 4749 - protein, 943 aa, Homo sapiens
MGIGLCVPPARCWKRLTRSSRGQPLERPAATIIIGLSIVERSKQTQRGPVDFSRSHSAPAAEQECKPRISAARSTPAPPSPAVPGFRTTPCQTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDRLQLEFARRAAPFNNWLDGAVEDLQDVWLVHSVEETQSLLTAHDQFKATLPEADERGAIMGIQGEIQKICQTYGLRPCSTNPYITLSPQDINTKWDMVRKLVPSCDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKQNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 4750 - protein, 72 aa, Homo sapiens
MMMVMQPEGLGAGEGRFAGGGGGGEYMEQEEDWDRDLLLDPAWEKQQRKENESSERERDWPRMHSKSVAELS

SEQ ID NO: 4751 - protein, 900 aa, Homo sapiens
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDRLQLEFARRAAPFNNWLDGAVEDLQDVWLVHSVEETQSLLTAHDQFKATLPEADERGAIMGIQGEIQKICQTYGLRPCSTNPYITLSPQDINTKWDMVRKLVPSCDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKQNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 4752 - protein, 505 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 4753 - protein, 447 aa, Homo sapiens
MYCAWMWPDQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 4754 - protein, 126 aa, Homo sapiens
MSDDKPFLCTAPGCGQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 4755 - protein, 505 aa, Homo sapiens; identical to SEQ ID NO: 4752

SEQ ID NO: 4756 - protein, 447 aa, Homo sapiens; identical to SEQ ID NO: 4753

SEQ ID NO: 4757 - protein, 209 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIV

SEQ ID NO: 4758 - protein, 395 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQ

SEQ ID NO: 4759 - protein, 237 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVSFDQSPWCLVFQESQVLPLPNQYSQKQK

SEQ ID NO: 4760 - protein, 487 aa, Homo sapiens
MSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 4761 - protein, 395 aa, Homo sapiens; identical to SEQ ID NO: 4758

SEQ ID NO: 4762 - protein, 395 aa, Homo sapiens; identical to SEQ ID NO: 4758

SEQ ID NO: 4763 - protein, 219 aa, Homo sapiens
MSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVSFDQSPWCLVFQESQVLPLPNQYSQKQK

SEQ ID NO: 4764 - protein, 377 aa, Homo sapiens [sequence omitted]

SEQ ID NO: 4765 - protein, 482 aa, Homo sapiens
MKFKLHVNSARQYKDLWNMSDDKPFLCTAPGCGQRFTNEDHLADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 4766 - protein, 711 aa, Homo sapiens
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 4767 - protein, 670 aa, Homo sapiens
MAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 4768 - protein, 711 aa, Homo sapiens; identical to SEQ ID NO: 4766

SEQ ID NO: 4769 - protein, 54 aa, Homo sapiens
MKLKLNVLTIILLPVHLLITIYSALIFIPWYFLTNAKKKNAMAKRIKAKPTSDK

SEQ ID NO: 4770 - protein, 145 aa, Homo sapiens
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTAL

SEQ ID NO: 4771 - protein, 126 aa, Homo sapiens
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWM

SEQ ID NO: 4772 - protein, 154 aa, Homo sapiens
MAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNE

SEQ ID NO: 4773 - protein, 128 aa, Homo sapiens
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNY

SEQ ID NO: 4774 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 4775 - protein, 258 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIHTDRAN

SEQ ID NO: 4776 - protein, 832 aa, Homo sapiens
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 4777 - protein, 832 aa, Homo sapiens
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKVNMATSRLIGAVAGTILALGVIFGGTGWGIENVKKRRFDPTQQGPI

SEQ ID NO: 4778 - protein, 832 aa, Homo sapiens
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKEMSRREGSILLSKAPSESAALDGHRLALLDSGYDILAAVLLELLSL

SEQ ID NO: 4779 - protein, 699 aa, Homo sapiens
MQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKDEGPKACFLKRTKCKSYPKHRKCQEEKVRSYSARPHLNQLRWMDTALHCWILGMTYSQQCYWNY

SEQ ID NO: 4780 - protein, 107 aa, Homo sapiens
  MOD_RES (1)..(1): Any amino acid
XQIQALNMSSCPLDSKGKVCSGHGVCSNEATCICDFTWAGTDCSIRDPVRNLHPPKDEGPKEMSRREGSILLSKAPSESAALDGHRLALLDSGYDILAAVLLELLSL

SEQ ID NO: 4781 - protein, 2843 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 4782 - protein, 2843 aa, Homo sapiens; identical to SEQ ID NO: 4781

SEQ ID NO: 4783 - protein, 2843 aa, Homo sapiens; identical to SEQ ID NO: 4781

SEQ ID NO: 4784 - protein, 287 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQIEKMRMFEC

SEQ ID NO: 4785 - protein, 118 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSF

SEQ ID NO: 4786 - protein, 1305 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIA

SEQ ID NO: 4787 - protein, 931 aa, Homo sapiens
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 4788 - protein, 1226 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 4789 - protein, 1195 aa, Homo sapiens
GYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 4790 - protein, 175 aa, Homo sapiens
MGKVLSKIFGNKEMRILMLGLDAAGKTTILYKLKLGQSVTTIPTVGFNVETVTYKNVKFNVWDVGGQDKIRPLWRHYYTGTQGLIFVVDCADRDRIDEARQELHRIINDREMRDAIILIFANKQDLPDAMKPHEIQEKLGLTRIRDRNWYVQPSCATSGDGLYEGLTWLTSNYKS

SEQ ID NO: 4791 - protein, 465 aa, Homo sapiens
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 4792 - protein, 541 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 4793 - protein, 544 aa, Homo sapiens
MPGRCQSDAAMRVNGPASRAPAGWTSGSLHTGPRAGRPRAQARGVRGRGLLLRPRPAKELPLPRKGGAWAPAGNPGPLHPLGVAVGMAGSGRLVLRPWIRELILGSETPSSPRAGQLLEVLQDAEAAVAGPSHAPDTSDVGATLLVSDGTHSVRCLVTREALDTSDWEEKEFGFRGTEGRLLLLQDCGVHVQVAEGGAPAEFYLQVDRFSLLPTEQPRLRVPGCNQDLDVQKKLYDCLEEHLSESTSSNAGLSLSQLLDEMREDQEHQGALVCLAESCLTLEGPCTAPPVTHWAASRCKATGEAVYTVPSSMLCISENDQLILSSLGPCQRTQGPELPPPDPALQDLSLTLIASPPSSPSSSGTPALPGHMSSEESGTSISLLPALSLAAPDPGQRSSSQPSPAICSAPATLTPRSPHASRTPSSPLQSCTPSLSPRSHVPSPHQALVTRPQKPSLEFKEFVGLPCKNRPPFPRTGATRGAQEPCSVWEPPKRHRDGSAFQYEYEPPCTSLCARVQAVRLPPQLMAWALHFLMDAQPGSEPTPM

SEQ ID NO: 4794 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 4795 - protein, 185 aa, Homo sapiens; identical to SEQ ID NO: 4794

SEQ ID NO: 4796 - protein, 185 aa, Homo sapiens; identical to SEQ ID NO: 4794

SEQ ID NO: 4797 - protein, 233 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRH

SEQ ID NO: 4798 - protein, 342 aa, Homo sapiens
MAAGTAVGAWVLVLSLWGAVVGAQNITARIGEPLVLKCKGAPKKPPQRLEWKLGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 4799 - protein, 347 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 4800 - protein, 404 aa, Homo sapiens [sequence omitted]

SEQ ID NO: 4801 - protein, 234 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRSLRTFTITASDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALR

SEQ ID NO: 4802 - protein, 133 aa, Homo sapiens
MKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 4803 - protein, 435 aa, Homo sapiens
MGAGERVQAPPRAEATAGRGADRARTLEGSRMAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 4804 - protein, 128 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQFENLHNYSL

SEQ ID NO: 4805 - protein, 153 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGILGGLGTAALLIGVILWQRRQRRGEERKAPENQEEEEERAELNQSEEPEAGESSTGGP

SEQ ID NO: 4806 - protein, 294 aa, Homo sapiens
MNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIGSVGGSGLGTLALALGILGGLGTAALLIGVILWQRRQRRGEERKAPENQEEEEERAELNQSEEPEAGESSTGGP

SEQ ID NO: 4807 - protein, 121 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNWWWSQKVEQ

SEQ ID NO: 4808 - protein, 363 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 4809 - protein, 1210 aa, Homo sapiens
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIASTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 4810 - protein, 421 aa, Homo sapiens
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKDSQHVSSVTQNQKQYDTSSKTHSNSQQGTSSMLEDDLQLSDSEDSDSEQTPAP

SEQ ID NO: 4811 - protein, 1218 aa, Homo sapiens
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 4812 - protein, 406 aa, Homo sapiens
MAFTERVNSSGNSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVETYSNEVHCVEEILKEMTHSWPPPLTAIHTPSTAEPSKFPFPTKDSQHVSSVTQ

SEQ ID NO: 4813 - protein, 490 aa, Homo sapiens
MPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPHLHLQVLHSPFQNQWHQHIPAVQSQKAPVTQTVPQTQRARAVQDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEK

SEQ ID NO: 4814 - protein, 849 aa, Homo sapiens
MTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 4815 - protein, 791 aa, Homo sapiens
MPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMAQRWW

SEQ ID NO: 4816 - protein, 149 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 4817 - protein, 5890 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGPKVKGDVDISLPKVEGDLKGPEVDIRGPQVDIDVPDVGVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGPKLNIEGKSKKSRFKLPKFNFSGSKVQTPEVDVKGKKPDIDITGPKVDINAPDVEVQGKVKGSKFKMPFLSISSPKVSMPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDIKGPKVDINAPDVDVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMQVPDLDIKGPKVDINAPDVDVRGPDWHLKMPKIKMPKISMPGFKGEGPEVDVNLPKADLDVSGPKVDVDVPDVNIEGPDAKLKGPKFKMPEMNIKAPKISMPDFDLHLKGPKVKGDVDVSLPKMEGDLKAPEVDIKGPKVDIDAPDVDVHGPDWHLKMPKVKMPKFSMPGFKGEGPEVDVNLPKADIDVSGPKVDIDTPDIDIHGPEGKLKGPKFKMPDLHLKAPKISMPEVDLNLKGPKMKGDVDVSLPKVEGDLKGPEVDIKGPKVDIDVPDVDVQGPDWHLKMPKVKMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDIKGPKVDIDAPDVDVHGPDWHLKMPKVKMPKFSMPGFKGEGPDVDVTLPKADIEISGPKVDIDAPDVSIEGPDAKLKGPKFKMPEMNIKAPKISMPDIDFNLKGPKVKGDVDVSLPKVEGDLKGPEIDIKGPSLDIDTPDVNIEGPEGKLKGPKFKMPEMNIKAPKISMPDFDLHLKGPKVKGDVDVSLPKVESDLKGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIRDPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 4818 - protein, 123 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQR

SEQ ID NO: 4819 - protein, 144 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLG

SEQ ID NO: 4820 - protein, 86 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKL

SEQ ID NO: 4821 - protein, 121 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSA

SEQ ID NO: 4822 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 4823 - protein, 103 aa, Homo sapiens
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVF

SEQ ID NO: 4824 - protein, 61 aa, Homo sapiens
MAKGFYISKSLGILGILLGVAAVCTIIALSVVYSQEKNKNANSSPVASTTPSASATTNPAS

SEQ ID NO: 4825 - protein, 126 aa, Homo sapiens [sequence omitted]

SEQ ID NO: 4826 - protein, 2492 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 4827 - protein, 2454 aa, Homo sapiens
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 4828 - protein, 122 aa, Homo sapiens
INYNRDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRG

SEQ ID NO: 4829 - protein, 1345 aa, Homo sapiens
MSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRS

SEQ ID NO: 4830 - protein, 160 aa, Homo sapiens
  MOD_RES (1)..(1): Any amino acid
XPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTVLHLNKMGMLKSIKYF

SEQ ID NO: 4831 - protein, 837 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEASTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLKNQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 4832 - protein, 822 aa, Homo sapiens
MAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 4833 - protein, 1620 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 4834 - protein, 450 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGKERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 4835 - protein, 644 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGEKFRVGNCKHLKMTRP

SEQ ID NO: 4836 - protein, 600 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGFFRMNKLKES

SEQ ID NO: 4837 - protein, 147 aa, Homo sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 4838 - protein, 147 aa, Homo sapiens; identical to SEQ ID NO: 4837

SEQ ID NO: 4839 - protein, 497 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4840 - protein, 152 aa, Homo sapiens
TVSNLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRG

SEQ ID NO: 4841 - protein, 498 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4842 - protein, 297 aa, Homo sapiens
MEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4843 - protein, 298 aa, Homo sapiens
MEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 4844 - protein, 496 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 4845 - protein, 495 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 4846 - protein, 444 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 4847 - protein, 406 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 4848 - protein, 368 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHHGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 4849 - protein, 239 aa, Homo sapiens
MAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 4850 - protein, 278 aa, Homo sapiens
MEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 4851 - protein, 131 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFV

SEQ ID NO: 4852 - protein, 175 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 4853 - protein, 195 aa, Homo sapiens
MSNYTDAESSFSKQEIIRVAMEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 4854 - protein, 416 aa, Homo sapiens
MWPTRRLVTIKRSGVDGPHFPLSLSTCLFGRYENESLQNGRKSTEFPRKIREQEPARRVSRSSFSSDPDESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNV

SEQ ID NO: 4855 - protein, 2896 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 4856 - protein, 3256 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGRKSGNLPSKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 4857 - protein, 3255 aa, Homo sapiens
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQNGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTANRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGLKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDPDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRPRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 4858 - protein, 46 aa, Homo sapiens
MWPTRRLVTIKRSGVDGPHFPLSLSTCLFGRRKCVLQCTECSKTAI

SEQ ID NO: 4859 - protein, 518 aa, Homo sapiens
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 4860 - protein, 318 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 4861 - protein, 318 aa, Homo sapiens; identical to SEQ ID NO: 4860

SEQ ID NO: 4862 - protein, 263 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYA

SEQ ID NO: 4863 - protein, 318 aa, Homo sapiens; identical to SEQ ID NO: 4860

SEQ ID NO: 4864 - protein, 174 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPN

SEQ ID NO: 4865 - protein, 108 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAEL

SEQ ID NO: 4866 - protein, 146 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGI

SEQ ID NO: 4867 - protein, 324 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKDI

SEQ ID NO: 4868 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 4869 - protein, 609 aa, Homo sapiens
MFRCGGLAAGALKQKLVPLVRTVCVRSPRQRNRLPVVQSHHLGSPSRSLASTGASGKDGSNLVYFLIVGATVTGAGVYYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 4870 - protein, 326 aa, Homo sapiens
MFRCGGLAAGALKQKLVPLVRTVCVRSPRQRNRLPARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 4871 - protein, 261 aa, Homo sapiens
MEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 4872 - protein, 274 aa, Homo sapiens
MGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 4873 - protein, 237 aa, Homo sapiens
MKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKDI

SEQ ID NO: 4874 - protein, 338 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKVVERCHWGILTDLLHKWNQS

SEQ ID NO: 4875 - protein, 1163 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 4876 - protein, 1205 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 4877 - protein, 1194 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 4878 - protein, 1205 aa, Homo sapiens; identical to SEQ ID NO: 4876

SEQ ID NO: 4879 - protein, 1163 aa, Homo sapiens; identical to SEQ ID NO: 4875

SEQ ID NO: 4880 - protein, 1237 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 4881 - protein, 1248 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 4882 - protein, 338 aa, Homo sapiens; identical to SEQ ID NO: 4874

SEQ ID NO: 4883 - protein, 674 aa, Homo sapiens
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 4884 - protein, 617 aa, Homo sapiens
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQLFLGMYPEEHFIEKPVKEAMARFRKNLEAIVSVIAERNKKKQLPYYYLSPDRIPNSVAI

SEQ ID NO: 4885 - protein, 836 aa, Homo sapiens
MHAQRQFVVAAVRAEVRRHEVAKQALNRLRKLAERVDDPELQDSIQASLDSIREAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 4886 - protein, 1192 aa, Homo sapiens
MSRGAGALQRRTTTYLISLTLVKLESVPPPPPSPSAAAAGAAGARGSETGDPGSPRGAEEPGKKRHERLFHRQDALWISTSSAGTGGAEPPALSPAPASPARPVSPAPGRRLSLWAVPPGPPLSGGLSPDPKPGGAPTSSRRPLLSSPSWGGPEPEGRAGGGIPGSSSPHPGTGSRRLKVAPPPPAPKPCKTVTTSGAKAGGGKGAGSRLSWPESEGKPRVKGSKSSAGTGASVSAAATAAAAGGGGSTASTSGGVGAGAGARGKLSPRKGKSKTLDNSDLHPGPPAGSPPPLTLPPTPSPATAVTAASAQPPGPAPPITLEPPAPGLKRGREGGRASTRDRKMLKFISGIFTKSTGGPPGSGPLPGPPSLSSGSGSRELLGAELRASPKAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEAKRKMWKLKSFGSLRNIYKAEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 4887 - protein, 394 aa, Homo sapiens
MDSQGRKVVVCDNGTGFVKCGYAGSNFPEHIFPALVGRPIIRSTTKVGNIEIKDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 4888 - protein, 399 aa, Homo sapiens
MDSQGRKVVVCDNGTGFVKCGYAGSNFPEHIFPALVGRPIIRSTTKVGNIEIKNNKKMDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 4889 - protein, 339 aa, Homo sapiens
MVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 4890 - protein, 305 aa, Homo sapiens
MVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSVSISKSTITNILLKGYTVVCES

SEQ ID NO: 4891 - protein, 418 aa, Homo sapiens
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 4892 - protein, 367 aa, Homo sapiens
MKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 4893 - protein, 356 aa, Homo sapiens
MLEIQNHSLSSLPWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 4894 - protein, 289 aa, Homo sapiens
MFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 4895 - protein, 582 aa, Homo sapiens
IDIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 4896 - protein, 508 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 4897 - protein, 625 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 4898 - protein, 526 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLSRVDTGHLGQVEWCTVLSRPDSRFLIAGMFTEPTSWKAGTQPSHSSQHPPTAWTACCPLEKVAQRGPTPLFQGFQGEPGLGQEK

SEQ ID NO: 4899 - protein, 625 aa, Homo sapiens; identical to SEQ ID NO: 4897

SEQ ID NO: 4900 - protein, 583 aa, Homo sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 4901 - protein, 626 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 4902 - protein, 582 aa, Homo sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 4903 - protein, 72 aa, Homo sapiens
MINIESMDTDKDDPHGRLEYTEHQGRIKNAREAHSQIEKRRRDKMNSFIDELASLVPTCNAMSRKLDKLTVL

SEQ ID NO: 4904 - protein, 76 aa, Homo sapiens
MADQRMDISSTISDFMSPGPTDLLSSSLGTSGVDCNRKRKGSSTDYQESMDTDKDDPHGRLEYTEHQGRIKNAREA

SEQ ID NO: 4905 - protein, 23 aa, Homo sapiens
MADQRMDISSTISDFMSPGPTDL

SEQ ID NO: 4906 - protein, 135 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEA

SEQ ID NO: 4907 - protein, 46 aa, Homo sapiens
MINIESMDTDKDDPHGRLEYTEHQGRIKNAREAHSQIEKRRRDKMN

SEQ ID NO: 4908 - protein, 141 aa, Homo sapiens
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQ

SEQ ID NO: 4909 - protein, 101 aa, Homo sapiens
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPT

SEQ ID NO: 4910 - protein, 59 aa, Homo sapiens
MADQRMDISSTISDFMSPGPTDLLSSSLGTSGVDCNRKRKGSSTDYQESMDTDKDDPHG

SEQ ID NO: 4911 - protein, 560 aa, Homo sapiens
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASRLSEEEQRLVQQAFQRNFFSMARQLPMKIRINGREDRAEASAAALNLTTSSIGSINMSVDIDGTTYAGVLFAQKPVVHLITGSAPQSLGSSASSSSSSHCSPSPTSSRGTPSAEPSTSWSL

SEQ ID NO: 4912 - protein, 444 aa, Homo sapiens
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASGTWCQ

SEQ ID NO: 4913 - protein, 470 aa, Homo sapiens [sequence omitted]

SEQ ID NO: 4914 - protein, 2644 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 4915 - protein, 2580 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEDRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 4916 - protein, 3056 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQNTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 4917 - protein, 138 aa, Homo sapiens
MTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRKLTIFSQ

SEQ ID NO: 4918 - protein, 3056 aa, Homo sapiens; identical to SEQ ID NO: 4916

SEQ ID NO: 4919 - protein, 1369 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFS

SEQ ID NO: 4920 - protein, 93 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKK

SEQ ID NO: 4921 - protein, 306 aa, Homo sapiens
MESIFHEKQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 4922 - protein, 369 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKDQHFHILKQQQKQQQQQQQQQQGDLSGQSSHPCERPATSSGALGSDLGDAMSEEDMLQAAVTMSLETVRNDLKTEGKK

SEQ ID NO: 4923 - protein, 361 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 4924 - protein, 366 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFENDYFDSQQQKQQQQQQQQQQGDLSGQSSHPCERPATSSGALGSDLGDAMSEEDMLQAAVTMSLETVRNDLKTEGKK

SEQ ID NO: 4925 - protein, 354 aa, Homo sapiens
MESIFHEKQEGSLCAQHCLNNLLQGEYFSPVELSSIAHQLDEEERMRMAEGGVTSEDYRTFLQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKDQHFHILKQQQKQQQQQQQQQQGDLSGQSSHPCERPATSSGALGSDLGDAMSEEDMLQAAVTMSLETVRNDLKTEGKK

SEQ ID NO: 4926 - protein, 370 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKTESRSVAQAQQQKQQQQQQQQQQGDLSGQSSHPCERPATSSGALGSDLGDAMSEEDMLQAAVTMSLETVRNDLKTEGKK

SEQ ID NO: 4927 - protein, 346 aa, Homo sapiens
MESIFHEKQEGSLCAQHCLNNLLQGEYFSPVELSSIAHQLDEEERMRMAEGGVTSEDYRTFLQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 4928 - protein, 364 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGKACSPFIMFATFTLYLTYELHVIFALHYSSFPL

SEQ ID NO: 4929 - protein, 372 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKFGRPRRADCLRQQQKQQQQQQQQQQGDLSGQSSHPCERPATSSGALGSDLGDAMSEEDMLQAAVTMSLETVRNDLKTEGKK

SEQ ID NO: 4930 - protein, 375 aa, Homo sapiens
DSVSKKKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKKFTANRTDQHFHILKQQQKQQQQQQQQQQGDLSGQSSHPCERPATSSGALGSDLGDAMSEEDMLQAAVTMSLETVRNDLKTEGKK

SEQ ID NO: 4931 - protein, 374 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKVFFKNLQQIGRARQQQKQQQQQQQQQQGDLSGQSSHPCERPATSSGALGSDLGDAMSEEDMLQAAVTMSLETVRNDLKTEGKK

SEQ ID NO: 4932 - protein, 370 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKIYFTFECFRQQQKQQQQQQQQQQGDLSGQSSHPCERPATSSGALGSDLGDAMSEEDMLQAAVTMSLETVRNDLKTEGKK

SEQ ID NO: 4933 - protein, 377 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKVFFKNLQQNQHFHILKQQQKQQQQQQQQQQGDLSGQSSHPCERPATSSGALGSDLGDAMSEEDMLQAAVTMSLETVRNDLKTEGKK

SEQ ID NO: 4934 - protein, 182 aa, Homo sapiens
MIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 4935 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 4936 - protein, 1091 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 4937 - protein, 1091 aa, Homo sapiens; identical to SEQ ID NO: 4936

SEQ ID NO: 4938 - protein, 1155 aa, Homo sapiens
MGAGKSPAGPGQKPDPGKLPAAGVLRILRGSSGLWKKRRARTSAETGRAGLSAAMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 4939 - protein, 830 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 4940 - protein, 503 aa, Homo sapiens
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 4941 - protein, 58 aa, Homo sapiens
MLSVRVAAAVVRALPRRAGLVSRNALGSSFIAARNFHASNTHLQKTGKLLFLSLRRTY

SEQ ID NO: 4942 - protein, 531 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 4943 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 4944 - protein, 553 aa, Homo sapiens; identical to SEQ ID NO: 4943

SEQ ID NO: 4945 - protein, 503 aa, Homo sapiens; identical to SEQ ID NO: 4940

SEQ ID NO: 4946 - protein, 1280 aa, Homo sapiens
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 4947 - protein, 22 aa, Homo sapiens
MDLEGDRNGGAKKKNFFKLNNK

SEQ ID NO: 4948 - protein, 48 aa, Homo sapiens
MDLEGDRNGGAKKKNFFKLNNKSEKDKKEKKPTVSVFSMFRYSNWLDK

SEQ ID NO: 4949 - protein, 1061 aa, Homo sapiens
ALSPVMGVSAGYWPKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 4950 - protein, 1216 aa, Homo sapiens
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTSDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 4951 - protein, 1466 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLRVIVLDKGEIQEYGAPSDLLQQRGLFYSMAKDAGLV

SEQ ID NO: 4952 - protein, 1475 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 4953 - protein, 1416 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 4954 - protein, 1472 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 4955 - protein, 1541 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGSTVMDEEEAGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 4956 - protein, 1531 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 4957 - protein, 1215 aa, Homo sapiens
MSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGSTVMDEEEAGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 4958 - protein, 655 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 4959 - protein, 611 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMVCWSISQPLHLGCHGFSTSAFHDMDLRLCSIMNFWDKTSAQDSMQQETILVTMQHVLAKNIW

SEQ ID NO: 4960 - protein, 403 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 4961 - protein, 403 aa, Homo sapiens; identical to SEQ ID NO: 4960

SEQ ID NO: 4962 - protein, 403 aa, Homo sapiens; identical to SEQ ID NO: 4960

SEQ ID NO: 4963 - protein, 347 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVRRN

SEQ ID NO: 4964 - protein, 403 aa, Homo sapiens; identical to SEQ ID NO: 4960

SEQ ID NO: 4965 - protein, 403 aa, Homo sapiens; identical to SEQ ID NO: 4960

SEQ ID NO: 4966 - protein, 403 aa, Homo sapiens; identical to SEQ ID NO: 4960

SEQ ID NO: 4967 - protein, 403 aa, Homo sapiens; identical to SEQ ID NO: 4960

SEQ ID NO: 4968 - protein, 403 aa, Homo sapiens; identical to SEQ ID NO: 4960

SEQ ID NO: 4969 - protein, 189 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLR

SEQ ID NO: 4970 - protein, 147 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNV

SEQ ID NO: 4971 - protein, 271 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELK

SEQ ID NO: 4972 - protein, 79 aa, Homo sapiens
MDRSKENCISGPVKATAPVGGPKRVLVTQQFPCQNPLPVNSGQAQRVLCPSNSSQRIPLQAQKLVSSHKPVQNQKQKQL

SEQ ID NO: 4973 - protein, 106 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAP

SEQ ID NO: 4974 - protein, 344 aa, Homo sapiens
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 4975 - protein, 303 aa, Homo sapiens
MSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 4976 - protein, 344 aa, Homo sapiens; identical to SEQ ID NO: 4974

SEQ ID NO: 4977 - protein, 309 aa, Homo sapiens
MSSPRAVVQLGKAQPAGEELATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 4978 - protein, 290 aa, Homo sapiens
MATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 4979 - protein, 275 aa, Homo sapiens
MRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 4980 - protein, 862 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 4981 - protein, 826 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRTRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 4982 - protein, 102 aa, Homo sapiens
  MOD_RES (1)..(1): Any amino acid
XLEEEEKRASRAPSKQRTRSQRKVGGGSAQPCDSIVVAYYFCGEPIPYRTLVRGRAVTLGQFKELLTKKGSYRPPSHLRCCLLTALLTSVLQILLQESERRV

SEQ ID NO: 4983 - protein, 618 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 4984 - protein, 569 aa, Homo sapiens
MSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 4985 - protein, 597 aa, Homo sapiens
MEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 4986 - protein, 534 aa, Homo sapiens [sequence omitted]

SEQ ID NO: 4987 - protein, 604 aa, Homo sapiens
MNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 4988 - protein, 604 aa, Homo sapiens; identical to SEQ ID NO: 4987

SEQ ID NO: 4989 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 4990 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 4991 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 4992 - protein, 143 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIERALLAE

SEQ ID NO: 4993 - protein, 4857 aa, Homo sapiens
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKEKSSNVKNENTSGTRKSENLRGCDLLQEVSVTIRRFKKTSISKERVQRCAMLQFSEFHEKLVNTLCRKTDDGQITEHAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDAMSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 4994 - protein, 521 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 4995 - protein, 552 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRCDLSAQGPEGREHGDGSARTLAGR

SEQ ID NO: 4996 - protein, 456 aa, Homo sapiens
MAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 4997 - protein, 375 aa, Homo sapiens
MLLPEGQRQRALGFGTVTSTYSPVGQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSR

SEQ ID NO: 4998 - protein, 534 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 4999 - protein, 520 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 5000 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 5001 - protein, 239 aa, Homo sapiens; identical to SEQ ID NO: 5000

SEQ ID NO: 5002 - protein, 205 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 5003 - protein, 706 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 5004 - protein, 706 aa, Homo sapiens; identical to SEQ ID NO: 5003

SEQ ID NO: 5005 - protein, 122 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCR

SEQ ID NO: 5006 - protein, 104 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMA

SEQ ID NO: 5007 - protein, 650 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 5008 - protein, 101 aa, Homo sapiens
MKFGMGSAQACPCQVPRAASTTWVPCQICETRGAAAAPPLTLEGPVQSHHGTPALTQGPQSPRDGAQLGACTRPVDVRDSGGRPLPPPDTLASAGDFLCTM

SEQ ID NO: 5009 - protein, 131 aa, Homo sapiens
MKFGMGSAQACPCQVPRAASTTWVPCQICGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 5010 - protein, 193 aa, Homo sapiens
MARARQEGSSPEPVEGLARDGPRPFPLGRLVPSAVSCGLCEPGLAAAPAAPTLLPAAYLCAPTAPPAVTAALGGSRWPGGPRSRPRGPRPDGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 5011 - protein, 261 aa, Homo sapiens
MKFGMGSAQACPCQVPRAASTTWVPCQICGPRERHGPRTPGGQLPGARRGPGPRRPAPLPARPPGALGSVLRPLRARPGCRPRRPHPAARCLPLRPHRPTRRHRRPGGFPLAWGSPQPAPRPAPGRSSALALAGGAAPGVARAQRPGGSGGRSHPGGPGSPRGGGTVGPGDRGPAAADGGRPQRTVRAAETRGAAAAPPLTLEGPVQSHHGTPALTQGPQSPRDGAQLGACTRPVDVRDSGGRPLPPPDTLASAGDFLCTM

SEQ ID NO: 5012 - protein, 435 aa, Homo sapiens
MLCGFQEDATPPPPPRPRRLHRRLPRPEEVGMLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 5013 - protein, 376 aa, Homo sapiens
MEPCPSSAPPPFYPGVGEVAGLRWFSIYDQRPSWYRTKKLGLLDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 5014 - protein, 229 aa, Homo sapiens
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPCQHLLRERKSPWKCV

SEQ ID NO: 5015 - protein, 219 aa, Homo sapiens
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 5016 - protein, 179 aa, Homo sapiens
MNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 5017 - protein, 179 aa, Homo sapiens; identical to SEQ ID NO: 5016

SEQ ID NO: 5018 - protein, 179 aa, Homo sapiens; identical to SEQ ID NO: 5016

SEQ ID NO: 5019 - protein, 211 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 5020 - protein, 191 aa, Homo sapiens
MASGQGPGPPRQECGEPALPSASEEQVAQDTEEVFRSYVFYRHQQQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 5021 - protein, 211 aa, Homo sapiens; identical to SEQ ID NO: 5019

SEQ ID NO: 5022 - protein, 153 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATRPAATPTACLRVASIGAVWWLFWASATVWPYTSTSMA

SEQ ID NO: 5023 - protein, 168 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 5024 - protein, 168 aa, Homo sapiens; identical to SEQ ID NO: 5023

SEQ ID NO: 5025 - protein, 149 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSRRLR

SEQ ID NO: 5026 - protein, 196 aa, Homo sapiens
MNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFPTLTLVLNEK

SEQ ID NO: 5027 - protein, 230 aa, Homo sapiens
MNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFKDSRLKRKGLVKKVQAFLAECDTVEQNICQETERLQSTNFALAE

SEQ ID NO: 5028 - protein, 345 aa, Homo sapiens
LAQRGGARRPRGDRERLGSRLRALRPGREPRQSEPPAQRGPPPSGRPPARSTASGHDRPTRGAAAGARRPRMKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFKDSRLKRKGLVKKVQAFLAECDTVEQNICQETERLQSTNFALAE

SEQ ID NO: 5029 - protein, 575 aa, Homo sapiens
MSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 5030 - protein, 325 aa, Homo sapiens
MQETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQPMTHRETAPVSQPENKPESKPGPVGPELPPGHIPIQVIRKEVDSKPVSQKPPPPSEKVEVKVPPAPVPCPPPSPGPSAVP

SEQ ID NO: 5031 - protein, 218 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 5032 - protein, 192 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 5033 - protein, 143 aa, Homo sapiens
MDGSGEQPRGGGPTSSEQIMKTGALLLQGMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 5034 - protein, 41 aa, Homo sapiens
MDGSGEQPRGGVSSRIEQGEWGGRHPSWPWTRCLRMRPPRS

SEQ ID NO: 5035 - protein, 179 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWTVTIFVAGVLTASLTIWKKMG

SEQ ID NO: 5036 - protein, 164 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKAGVKWRDLGSLQPLPPGFKRFTCLSIPRSWDYRPCAPRCRN

SEQ ID NO: 5037 - protein, 160 aa, Homo sapiens
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 5038 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 5039 - protein, 170 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQDTFVELYGNNAAAESRKGQERFNRWFLTGMTVAGVVLLGSLFSRK

SEQ ID NO: 5040 - protein, 233 aa, Homo sapiens; identical to SEQ ID NO: 5038

SEQ ID NO: 5041 - protein, 188 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGW

SEQ ID NO: 5042 - protein, 233 aa, Homo sapiens; identical to SEQ ID NO: 5038

SEQ ID NO: 5043 - protein, 188 aa, Homo sapiens; identical to SEQ ID NO: 5041

SEQ ID NO: 5044 - protein, 48 aa, Homo sapiens
MSQSNRELVVDFLSYKLSQKGYSWSQFSDVEENRTEAPEGTESEMETP

SEQ ID NO: 5045 - protein, 181 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPW

SEQ ID NO: 5046 - protein, 205 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRK

SEQ ID NO: 5047 - protein, 188 aa, Homo sapiens; identical to SEQ ID NO: 5041

SEQ ID NO: 5048 - protein, 204 aa, Homo sapiens
MVDQLRERTTMADPLRERTELLLADYLGYCAREPGTPEPAPSTPEAAVLRSAAARLRQIHRSFFSAYLGYPGNRFELVALMADSVLSDSPGPTWGRVVTLVTFAGTLLERGPLVTARWKKWGFQPRLKEQEGDVARDCQRLVALLSSRLMGQHRAWLQAQGGWDGFCHFFRTPFPLAFWRKQLVQAFLSCLLTTAFIYLWTRLL

SEQ ID NO: 5049 - protein, 138 aa, Homo sapiens
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 5050 - protein, 112 aa, Homo sapiens
MAKQPSDVSSECDREGRQLQPAERPPQLRPGAPTSLQTEPQDRSPAPMSCDKSTQTPSPPCQAFNHYLSAMVVILEDIGDLSLCFGFIFTGLDLYGHHHSQDTEQLNHKDFS

SEQ ID NO: 5051 - protein, 172 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRMPLPPD

SEQ ID NO: 5052 - protein, 72 aa, Homo sapiens
MAKQPSDVSSECDREGRQLQPAERPPQLRPGAPTSLQTEPQGNPEGNHGGEGDSCPHGSPQGPLAPPASPGP

SEQ ID NO: 5053 - protein, 85 aa, Homo sapiens
MAKQPSDVSSECDREGRQLQPAERPPQLRPGAPTSLQTEPQASMRQAEPADMRPEIWIAQELRRIGDEFNAYYARRLAKLLASST

SEQ ID NO: 5054 - protein, 198 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 5055 - protein, 122 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQ

SEQ ID NO: 5056 - protein, 73 aa, Homo sapiens
MRQAEPADMRPEIWIAQELRRIGDEFNAYYARRVMMFSLPAFLLTPSPSTLYFFKKTVTSCNYMLILEMITVA

SEQ ID NO: 5057 - protein, 80 aa, Homo sapiens
MAKQPSDVSSECDREGRQLQPAERPPQLRPGAPTSLQTEPQDRSPAPMSCDKSTQTPSPPCQAFNHYLSAMVREIEEVVV

SEQ ID NO: 5058 - protein, 135 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMANWD

SEQ ID NO: 5059 - protein, 140 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMVREIEEVVV

SEQ ID NO: 5060 - protein, 96 aa, Homo sapiens
KQPSDVSSECDREGRQLQPAERPPQLRPGAPTSLQTEPQDRSPAPMSCDKSTQTPSPPCQAFNHYLSAMDDSAGSSLRIALHREVQWPLKWLAKSS

SEQ ID NO: 5061 - protein, 82 aa, Homo sapiens
MAKQPSDVSSECDREGRQLQPAERPPQLRPGAPTSLQTEPQASMRQAEPADMRPEIWIAQELRRIGDEFNAYYARRMPLPPD

SEQ ID NO: 5062 - protein, 193 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTALYGDGALEEARRLREGNWASVRTVLTGAVALGALVTVGAFFASK

SEQ ID NO: 5063 - protein, 51 aa, Homo sapiens
MATPASAPDTRALVADFVGYKLRQKGYVCGAGPGEGPAADPLHQAMRAAGD

SEQ ID NO: 5064 - protein, 72 aa, Homo sapiens
MATPASAPDTRALVADFVGYKLRQKGYVCGAGPGEGPAADPLHQAMRAAGDEFETRFRRTFSDLAAQLHVTP

SEQ ID NO: 5065 - protein, 149 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTA

SEQ ID NO: 5066 - protein, 144 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGW

SEQ ID NO: 5067 - protein, 175 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 5068 - protein, 163 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWGKWHNHTPMLVESVAHKKRKMAL

SEQ ID NO: 5069 - protein, 241 aa, Homo sapiens
MCSGAGVMMARWAARGRAGWRSTVRILSPLGHCEPGVSRSCRAAQAMDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 5070 - protein, 137 aa, Homo sapiens
MDCEVNNGSSLRDECITNLLVFGFLQSCSDNSFRRELDALGHELPVLAPQWEGYDELQTDGNRSSHSRLGRIEAGASDNNTASAEEETEAAGSVAVERGLHGAATVILKVKKTSSGILPGTSPRSGTAWTVASLRAW

SEQ ID NO: 5071 - protein, 99 aa, Homo sapiens
MDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 5072 - protein, 99 aa, Homo sapiens; identical to SEQ ID NO: 5071

SEQ ID NO: 5073 - protein, 195 aa, Homo sapiens
MDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 5074 - protein, 195 aa, Homo sapiens; identical to SEQ ID NO: 5073

SEQ ID NO: 5075 - protein, 450 aa, Homo sapiens
MEEPQKSYVNTMDLERDEPLKSTGPQISVSEFSCHCCYDILVNPTTLNCGHSFCRHCLALWWASSKKTECPECREKWEGFPKVSILLRDAIEKLFPDAIRLRFEDIQQNNDIVQSLAAFQKYGNDQIPLAPNTGRANQQMGGGFFSGVLTALTGVAVVLLVYHWSSRESEHDLLVHKAVAKWTAEEVVLWLEQLGPWASLYRERFLSERVNGRLLLTLTEEEFSKTPYTIENSSHRRAILMELERVKALGVKPPQNLWEYKAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 5076 - protein, 322 aa, Homo sapiens
MVGIFKENRMSRMQRKMGRFPQSQYSPQVVLLVYHWSSRESEHDLLVHKAVAKWTAEEVVLWLEQLGPWASLYRERFLSERVNGRLLLTLTEEEFSKTPYTIENSSHRRAILMELERVKALGVKPPQNLWEYKAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 5077 - protein, 1417 aa, Homo sapiens
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 5078 - protein, 1047 aa, Homo sapiens
MSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 5079 - protein, 519 aa, Homo sapiens
MNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRN

SEQ ID NO: 5080 - protein, 326 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 5081 - protein, 238 aa, Homo sapiens
MCVLCGGYFIDATTIIECLHSFCKTCIVRYLETSKYCPICDVQVHKTRPLLNIRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 5082 - protein, 105 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSAD

SEQ ID NO: 5083 - protein, 207 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLM

SEQ ID NO: 5084 - protein, 150 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKD

SEQ ID NO: 5085 - protein, 184 aa, Homo sapiens
YFIDATTIIECLHSFCKTCIVRYLETSKYCPICDVQVHKTRPLLNIRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPV

SEQ ID NO: 5086 - protein, 92 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFTANGS

SEQ ID NO: 5087 - protein, 730 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 5088 - protein, 986 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 5089 - protein, 302 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGVLHSSLLLLSCGSRNGASFPCSLESSIHQALCWTGLFLRPSPFPRLPLAAPRTLRAGV

SEQ ID NO: 5090 - protein, 622 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGKPLLWDRHCFRLSTHGPEMLGTALRG

SEQ ID NO: 5091 - protein, 823 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSVLEGAGDRHSHLSGLELLLCPHALVDTVPAPPSALHGDTHAHTHTHVHTHCPIAQETCRGPPLGASRLSPQGPGHLTLAPQEGSYLDFWDTHRGDPKPRRRRKSLKTFSLTPATFRGIWAL

SEQ ID NO: 5092 - protein, 730 aa, Homo sapiens; identical to SEQ ID NO: 5087

SEQ ID NO: 5093 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 5094 - protein, 502 aa, Homo sapiens; identical to SEQ ID NO: 5093

SEQ ID NO: 5095 - protein, 532 aa, Homo sapiens
MGWLEELNWQLHIFLLILLSMHTRANFLDNMLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 5096 - protein, 114 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRVRTLPFLIKEDQLNAAQKGTNVIKTYTLHCLH

SEQ ID NO: 5097 - protein, 125 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHH

SEQ ID NO: 5098 - protein, 502 aa, Homo sapiens; identical to SEQ ID NO: 5093

SEQ ID NO: 5099 - protein, 502 aa, Homo sapiens; identical to SEQ ID NO: 5093

SEQ ID NO: 5100 - protein, 502 aa, Homo sapiens; identical to SEQ ID NO: 5093

SEQ ID NO: 5101 - protein, 1584 aa, Homo sapiens
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 5102 - protein, 1584 aa, Homo sapiens; identical to SEQ ID NO: 5101

SEQ ID NO: 5103 - protein, 777 aa, Homo sapiens
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 5104 - protein, 567 aa, Homo sapiens
MWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREHCQSCLMDATSICGEPSNTIQRTTLLSSSLQVGARSSVESPSQTVT

SEQ ID NO: 5105 - protein, 1249 aa, Homo sapiens
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTSPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 5106 - protein, 314 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDVPMTPLRTVMLIPGDKMNEIMDKLKEYLSV

SEQ ID NO: 5107 - protein, 292 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGWSVPPVLE

SEQ ID NO: 5108 - protein, 322 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGGSRGQVTALVSLKAGLIQSRSTLSDFQGTFMTVGIALS

SEQ ID NO: 5109 - protein, 292 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDWSVPPVLE

SEQ ID NO: 5110 - protein, 262 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGWSVPPVLE

SEQ ID NO: 5111 - protein, 465 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGEHPGAAEEVFQKLLPDIRGAADADQLVCETPDCPQHSADHQ

SEQ ID NO: 5112 - protein, 458 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCLCLPAWPSGCTAATARVTRS

SEQ ID NO: 5113 - protein, 1271 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 5114 - protein, 936 aa, Homo sapiens
PSAPRVSTVGLLCSGAGPHLCPCAEEGTGGLESQGEIIPSRGSRKPDGVSGSRRLFSSLCKSQEGSRKECLRKHRRLGPAMPVSSPGFPGPLARSEHHLDTAALQTGQRSSAGTKMGCPTLMTRPPHRPTSAARAGAAGMRWSREPWSPLKRSELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 5115 - protein, 1227 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNELDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 5116 - protein, 467 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAVLKTEVPHQGVRRARLSLEALGEDPSFLFPASDGPRHSSTW

SEQ ID NO: 5117 - protein, 454 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAAGRPPHLTELPVQHQ

SEQ ID NO: 5118 - protein, 1567 aa, Homo sapiens
MNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5119 - protein, 1624 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5120 - protein, 680 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5121 - protein, 721 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5122 - protein, 1598 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKGVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5123 - protein, 1863 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5124 - protein, 712 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5125 - protein, 1884 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5126 - protein, 63 aa, Homo sapiens
MDLSALRVEEVQNVINAMQKILECPICLELIKEPVSTKCDHIFCKFCMLKLLNQKKGPSQCPL

SEQ ID NO: 5127 - protein, 63 aa, Homo sapiens; identical to SEQ ID NO: 5126

SEQ ID NO: 5128 - protein, 699 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTGCPPNCGCAARCLDRGQWLPCNWADV

SEQ ID NO: 5129 - protein, 649 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEE

SEQ ID NO: 5130 - protein, 1885 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5131 - protein, 222 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELGSDSSEDTVNKATYCSVGDQELLQITPQGTRDEISLDSAKK

SEQ ID NO: 5132 - protein, 622 aa, Homo sapiens
MDLSALRVEEVQNVINAMQKILECPICLELIKEPVSTKCDHIFCKSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSE

SEQ ID NO: 5133 - protein, 623 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERK

SEQ ID NO: 5134 - protein, 498 aa, Homo sapiens
ELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERK

SEQ ID NO: 5135 - protein, 98 aa, Homo sapiens
MDLSALRVEEVQNVINAMQKILECPICLELIKEPVSTKCDHIFCKSLQESTRFSQLVEELLKIICAFQLDTGLEYANSYNFAKKENNSPEHLKDEVSI

SEQ ID NO: 5136 - protein, 759 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5137 - protein, 59 aa, Homo sapiens
MDLSALRVEEVQNVINAMQKILECPICLELIKEPVSTKCDHIFCKVLLCCPSWSTVVRS

SEQ ID NO: 5138 - protein, 1816 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 5139 - protein, 572 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQS

SEQ ID NO: 5140 - protein, 473 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPN

SEQ ID NO: 5141 - protein, 177 aa, Homo sapiens
MNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPN

SEQ ID NO: 5142 - protein, 3418 aa, Homo sapiens [sequence omitted]

SEQ ID NO: 5143 - protein, 602 aa, Homo sapiens
MPIGSKERPTFFEIFKTRCNKAGPISLNWFEELSSEAPPYNSEPAEESEHKNNNYEPNLFKTPQRKPSYNQLASTPIIFKEQGLTLPLYQSPVKELDKFKLDLGRNVPNSRHKSLRTVKTKMDQADDVSCPLLNSCLSESPVVLQCTHVTPQRDKSVVCGSLFHTPKFVKGRQTPKHISESLGAEVDPDMSWSSSLATPPTLSSTVLIVRNEEASETVFPHDTTANVKSYFSNHDESLKKNDRFIASVTDSENTNQREAASHGFGKTSGNSFKVNSCKDHIGKSMPNVLEDEVYETVVDTSEEDSFSLCFSKCRTKNLQKVRTSKTRKKIFHEANADECEKSKNQVKEKYSFVSEVEPNDTDPLDSNVANQKPFESGSDKISKEVVPSLACEWSQLTLSGLNGAQMEKIPLLHISSCDQNISEKDLLDTENKRKKDFLTSENSLPRISSLPKSEKPLNEETVVNKRDEEQHLESHTDCILAVKQAISGTSPVASSFQGIKKSIFRIRESPKETFNASFSGHMTDPNFKKETEASESGLEIHTVCSQKEDSLCPNLIDNGSWPATTTQNSVALKNAGLISTLKKKTNKFIYAIHDETSYKGKK

SEQ ID NO: 5144 - protein, 3418 aa, Homo sapiens [sequence omitted]

SEQ ID NO: 5145 - protein, 888 aa, Homo sapiens
MHCPGEAPLAAPRPTPKDPCLRNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5146 - protein, 870 aa, Homo sapiens
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5147 - protein, 888 aa, Homo sapiens
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVSKCQGNARARLRLWGVWVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5148 - protein, 916 aa, Homo sapiens
MPAKPFLSSVLLSWKVLDFSGPGPQGTGQPCSCGHWAEGQGGPPEPAGGPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5149 - protein, 888 aa, Homo sapiens
MLTHRPQEAEQRGRTPGPSFEWNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5150 - protein, 722 aa, Homo sapiens
MQGKNVLAKALYDNVAESPDELSFRKGDIMTVLEQDTQGLDGWWLCSLHGRQGIVPGNRLKILVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5151 - protein, 870 aa, Homo sapiens
MSVPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5152 - protein, 868 aa, Homo sapiens
MENVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5153 - protein, 841 aa, Homo sapiens
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5154 - protein, 246 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDGP

SEQ ID NO: 5155 - protein, 290 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDDRRTHRPLRVCPARLLWCCWALPLHLALAWTPPLPSSRPAQLWPWS

SEQ ID NO: 5156 - protein, 244 aa, Homo sapiens
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSD

SEQ ID NO: 5157 - protein, 497 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5158 - protein, 593 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5159 - protein, 518 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5160 - protein, 409 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5161 - protein, 506 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5162 - protein, 454 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5163 - protein, 550 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5164 - protein, 482 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5165 - protein, 475 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5166 - protein, 439 aa, Homo sapiens
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 5167 - protein, 651 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 5168 - protein, 652 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEQITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 5169 - protein, 652 aa, Homo sapiens; identical to SEQ ID NO: 5168

SEQ ID NO: 5170 - protein, 659 aa, Homo sapiens
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 5171 - protein, 208 aa, Homo sapiens
VIRHYVVCSTPQSQYYLAEKHLFSTIPELINYHQHNSAGLISRTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 5172 - protein, 139 aa, Homo sapiens
VIRHYVVCSTPQSQYYLAEKHLFSTIPELINYHQHNSAGLISRLKYPVSQQNKNAPSTAGLGYGVLMWEIYSLGKMPYERFTNSETAEHIAQGLRLYRPHLASEKVYTIMYSCWHEKADERPTFKILLSNILDVMDEES

SEQ ID NO: 5173 - protein, 234 aa, Homo sapiens
RHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 5174 - protein, 74 aa, Homo sapiens
VIRHYVVCSTPQSQYYLAEKHLFSTIPELINYHQHNSAGLISRLKYPVSQQNKNAPSTAGLGYGMSWMMNTQAQ

SEQ ID NO: 5175 - protein, 483 aa, Homo sapiens
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 5176 - protein, 172 aa, Homo sapiens
VIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLPCTVAGMRKQMSVPLSKFF

SEQ ID NO: 5177 - protein, 197 aa, Homo sapiens
VIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLVCPG

SEQ ID NO: 5178 - protein, 51 aa, Homo sapiens
IRHYVVCSTPQSQYYLAEKHLFSTIPELINYHQHNSAGEDSAAARDVQGCL

SEQ ID NO: 5179 - protein, 296 aa, Homo sapiens
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRRDGVSPCWPDCSQTPDLVIRPPWPPKALDYRREPLRPASSFLIMYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 5180 - protein, 252 aa, Homo sapiens
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 5181 - protein, 46 aa, Homo sapiens
MKNEIAAVVFFFTRLVRKHDKLKKEAVERFAEKLTLILQEKYKNHW

SEQ ID NO: 5182 - protein, 519 aa, Homo sapiens
MMSEHDLADVVQIAVEDLSPDHPVVLENHVVTDEDEPALKRQRLEINCQDPSIKTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVGHLHIAQVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQ

SEQ ID NO: 5183 - protein, 465 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 5184 - protein, 469 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 5185 - protein, 497 aa, Homo sapiens
MMSEHDLADVVQIAVEDLSPDHPGTELWDIVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQ

SEQ ID NO: 5186 - protein, 519 aa, Homo sapiens; identical to SEQ ID NO: 5182

SEQ ID NO: 5187 - protein, 491 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQ

SEQ ID NO: 5188 - protein, 118 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNK

SEQ ID NO: 5189 - protein, 28 aa, Homo sapiens
MMSEHDLADVVQIAVEDLSPDHPVVLEN

SEQ ID NO: 5190 - protein, 95 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNK

SEQ ID NO: 5191 - protein, 123 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVV

SEQ ID NO: 5192 - protein, 195 aa, Homo sapiens
MMSEHDLADVVQIAVEDLSPDHPGTELWDIVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLG

SEQ ID NO: 5193 - protein, 119 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKV

SEQ ID NO: 5194 - protein, 466 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 5195 - protein, 250 aa, Homo sapiens
MGSPEPTQGPRLSPILIPYSGRRYKVGRASGALCHQDSLPPILELGLTFLRASAGFSVPTSSSFALPEPLRSLCLGNGEGLGLSLTLTVLAWILGLSGTLGALVLFMVATGIFQEALWHLLLLSFSVEALPCFFFFPFFLLCRCLRAELQIQQRLDGTLSLDLMRLESDGETGCAAESSVLQGAQLIAVASSDPAAAGVDGSPLQGSDIQVQYVQLAPVSDHTAGAQTAEALQPTLQPEMQLEHGAIQIQ

SEQ ID NO: 5196 - protein, 508 aa, Homo sapiens
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 5197 - protein, 491 aa, Homo sapiens; identical to SEQ ID NO: 5187

SEQ ID NO: 5198 - protein, 1050 aa, Homo sapiens
MAAVKKEGGALSEAMSLEGDEWELSKENVQPLRQGRIMSTLQGALAQESACNNTLQQQKRAFEYEIRFYTGNDPLDVWDRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 5199 - protein, 1064 aa, Homo sapiens
MAAVKKEGGALSEAMSLEGDEWELSKENVQPLRQGRIMSTLQGALAQESACNNTLQQQKRAFEYEIRFYTGNDPLDVWDRWVFLFHKDNRNINRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 5200 - protein, 933 aa, Homo sapiens
MAAVKKEGGALSEAMSLEGDEWELSKENVQPLRQGRIMSTLQGALAQESACNNTLQQQKRAFEYEIRFYTGNDPLDVWDRYISWTEQNYPQGGKESNMSTLLERAVEALQGENFWKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKVSLSLGPSVPFSIFDEFLLSEKKNKSPPADPPRVLAQRRPLAVLKTSESITSNEDVSPDVCDEFTGIEPLSEDAIITGFRNVTICPNPEDTREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 5201 - protein, 1130 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 5202 - protein, 1149 aa, Homo sapiens
MGQQPGKVLGDQRRPSLPALHFIKGAGKKESSRHGGPHCNVFVEHEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 5203 - protein, 64 aa, Homo sapiens
MGQQPGKVLGDQRRPSLPALHFIKGAGKKESSRHGGPHCNVFVEQALQRPVASDFEPQGLSEAA

SEQ ID NO: 5204 - protein, 161 aa, Homo sapiens
GRPGRSRARGGGEGGWRGGGRAGRAGPEPGPRAGRGVPAPDCWRGKMLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNY

SEQ ID NO: 5205 - protein, 945 aa, Homo sapiens
LRLLREPLQHPGRVGSSSFNGGRRAHHHAPLSSPKAQQAHCLWCVPQLRQVGDGTHGHHHEAQGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 5206 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 5207 - protein, 647 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNLASQSIGITDMSHCTCPAPQLPAIF

SEQ ID NO: 5208 - protein, 900 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKLARCRNWHPHSCSYPCPLGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 5209 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 5210 - protein, 796 aa, Homo sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 5211 - protein, 693 aa, Homo sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLGCPSLMEPPSPREDMRLLYLGFQLMLFSYVKVNRRFCLLGVFIKLPFLYVVATESPTTLTSL

SEQ ID NO: 5212 - protein, 171 aa, Homo sapiens
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRNSLSRSRTLMTTLRSSCTRPIMPTCLRGPMWVRT

SEQ ID NO: 5213 - protein, 779 aa, Homo sapiens
MGPGLAARRLRPPSRAPEITVFSAQRPCDIPSCCHLLSDQSDGWSVLQKLAASIQWVKKLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 5214 - protein, 175 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKMKIWQVLCLARWLT

SEQ ID NO: 5215 - protein, 713 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 5216 - protein, 760 aa, Homo sapiens
MKTPPGASSRTKCSRELRSFCAFSCPRAKQPTCTAWFPQQEHPSENGPQMPGRDPPAASTMQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACK

SEQ ID NO: 5217 - protein, 713 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACK

SEQ ID NO: 5218 - protein, 190 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKRTHNPINSELLLNEGITADLNPCITILAI

SEQ ID NO: 5219 - protein, 175 aa, Homo sapiens; identical to SEQ ID NO: 5214

SEQ ID NO: 5220 - protein, 674 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACK

SEQ ID NO: 5221 - protein, 415 aa, Homo sapiens
MQPRTPLVLCVLLSQVALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACK

SEQ ID NO: 5222 - protein, 272 aa, Homo sapiens
MQPRTPLVLCVLLSQVLLLTSAEDLDCTPGFQQKVFHINQPAEFIEEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACK

SEQ ID NO: 5223 - protein, 403 aa, Homo sapiens
VVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 5224 - protein, 906 aa, Homo sapiens
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 5225 - protein, 875 aa, Homo sapiens
MFLLRRYVCIFTEKLKNQAELYVFLSVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 5226 - protein, 784 aa, Homo sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 5227 - protein, 669 aa, Homo sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 5228 - protein, 223 aa, Homo sapiens
MPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 5229 - protein, 525 aa, Homo sapiens
MPSTCSKENMWARSSGSMQRQETCSPLRAQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 5230 - protein, 790 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLVTVVLFAALRRQRKKEPLIISKEDIRDNIVSYNDEGGGEEDTQAFDIGTLRNPEAIEDNKLRRDIVPEALFLPRRTPTARDNTDVRDFINQRLKENDTDPTAPPYDSLATYAYEGTGSVADSLSSLESVTTDADQDYDYLSDWGPRFKKLADMYGGVDSDKDS

SEQ ID NO: 5231 - protein, 191 aa, Homo sapiens
MGGSGSRLSKELLAEYQDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 5232 - protein, 78 aa, Homo sapiens
MSEVLPYGDEKLSPYGDGGDVGQIFSCRLQDTNNFFGAGQNKRPPKLGQIGRSKRVVIEDDRIDDVLKNMTDKAPPGV

SEQ ID NO: 5233 - protein, 520 aa, Homo sapiens
MEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLALQNQAQNIQLDSTNIAKPHSLLPSEQQDSGSTWAARSVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLV

SEQ ID NO: 5234 - protein, 505 aa, Homo sapiens
MEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 5235 - protein, 532 aa, Homo sapiens
MQFGKLWCGCSGEFPTRLRRRTPLTEAMEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 5236 - protein, 543 aa, Homo sapiens
MEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLALQNQAQNIQLDSTNIAKPHSLLPSEQQDSGSTWAARSVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 5237 - protein, 564 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5238 - protein, 793 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQVEVMVEEKTTESQEETVVMSLKNGQISSEEPKQEEEREQGSDEISHHEKMEEEDKERAEAERARLEAEERERIKAEQDKKIADERARIEAEEKAAAQERERREAEERERMREEEKRAAEERQRIKEEEKRAAEERQRIKEEEKRAAEERQRIKEEEKRAAEERQRARAEEEEKAKVEEQKRNKQLEEKKHAMQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5239 - protein, 538 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5240 - protein, 558 aa, Homo sapiens
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5241 - protein, 538 aa, Homo sapiens; identical to SEQ ID NO: 5239

SEQ ID NO: 5242 - protein, 563 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5243 - protein, 532 aa, Homo sapiens
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5244 - protein, 175 aa, Homo sapiens
MPEDGLSDDKKPFKCFTPKGSSLKIEERAEFLNKSVQKSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSLTFCSSLFGLWLIGNLLLLPSFLPLLPEWVFL

SEQ ID NO: 5245 - protein, 72 aa, Homo sapiens
MDDFERRRELRRQKREEMRLEAERIAYQRNDDDEEEAARERRRRARQERLRQKQEEESLGQVTDQVEVNAQN

SEQ ID NO: 5246 - protein, 459 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKS

SEQ ID NO: 5247 - protein, 72 aa, Homo sapiens; identical to SEQ ID NO: 5245

SEQ ID NO: 5248 - protein, 543 aa, Homo sapiens
MTSYMKVDRQWNAEILELILGTGQLSTGQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 5249 - protein, 1324 aa, Homo sapiens
MADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 5250 - protein, 1602 aa, Homo sapiens
MVDASGRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 5251 - protein, 1613 aa, Homo sapiens
MVDASGRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKSPSKWYWKLVPVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 5252 - protein, 660 aa, Homo sapiens
MRMPSSTWARIMSSCGCDACRVGPSSVMRPSPRYPRAWVTRTWVPIPPRPMASSGSVPRDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 5253 - protein, 714 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 5254 - protein, 714 aa, Homo sapiens; identical to SEQ ID NO: 5253

SEQ ID NO: 5255 - protein, 162 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDV

SEQ ID NO: 5256 - protein, 714 aa, Homo sapiens; identical to SEQ ID NO: 5253

SEQ ID NO: 5257 - protein, 152 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQ

SEQ ID NO: 5258 - protein, 162 aa, Homo sapiens; identical to SEQ ID NO: 5255

SEQ ID NO: 5259 - protein, 163 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVV

SEQ ID NO: 5260 - protein, 191 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALL

SEQ ID NO: 5261 - protein, 170 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPI

SEQ ID NO: 5262 - protein, 122 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIA

SEQ ID NO: 5263 - protein, 63 aa, Homo sapiens
MSEEIITPVYCTGVSAQVQKQRARELGLGRHENAIKYLGQDYEQLRVRCLQSGTLFRDEAFPP

SEQ ID NO: 5264 - protein, 714 aa, Homo sapiens; identical to SEQ ID NO: 5253

SEQ ID NO: 5265 - protein, 714 aa, Homo sapiens; identical to SEQ ID NO: 5253

SEQ ID NO: 5266 - protein, 148 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGI

SEQ ID NO: 5267 - protein, 136 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVP

SEQ ID NO: 5268 - protein, 700 aa, Homo sapiens
MAGIAAKLAKDREAAEGLGSHDRAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 5269 - protein, 729 aa, Homo sapiens
APGPGRAPAERSAESPRPFSAQYGRRDRSMAGIAAKLAKDREAAEGLGSHDRAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVHPQLSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 5270 - protein, 622 aa, Homo sapiens
MEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 5271 - protein, 131 aa, Homo sapiens
MEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTG

SEQ ID NO: 5272 - protein, 51 aa, Homo sapiens
MKNREAARECRRKKKEYVKCLENRVAVLENQNKTLIEELKALKDLYCHKSD

SEQ ID NO: 5273 - protein, 327 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 5274 - protein, 230 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSALPTQPAEEAARKREVRLMKNREAARECRRKKKEYVKCLENRVAVLENQNKTLIEELKALKDLYCHKSD

SEQ ID NO: 5275 - protein, 79 aa, Homo sapiens
MTMESGAENQQSGDAAVTEAENQQMTVQAQPQIATLAQVSMPAAHATSSAPTVTLVQLPNGQTVQVHGVIQAAQPSVIQ

SEQ ID NO: 5276 - protein, 327 aa, Homo sapiens; identical to SEQ ID NO: 5273

SEQ ID NO: 5277 - protein, 341 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 5278 - protein, 182 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQY

SEQ ID NO: 5279 - protein, 132 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRP

SEQ ID NO: 5280 - protein, 234 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQGTQKL

SEQ ID NO: 5281 - protein, 153 aa, Homo sapiens
MPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYTYLRDTTYSCQ

SEQ ID NO: 5282 - protein, 120 aa, Homo sapiens
MDDSKVVGGKVKKPGKRGRKPAKIDLKAKLERSRQSARECRARKKLRYQYLEELVSSRERAICALREELEMYKQWCMAMDQGKIPSEIKALLTGEEQNKSQQNSSRHTKAGKTDANSNSW

SEQ ID NO: 5283 - protein, 312 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 5284 - protein, 459 aa, Homo sapiens
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 5285 - protein, 356 aa, Homo sapiens [sequence omitted]

SEQ ID NO: 5286 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 5287 - protein, 420 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 5288 - protein, 702 aa, Homo sapiens; identical to SEQ ID NO: 5286

SEQ ID NO: 5289 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 5290 - protein, 658 aa, Homo sapiens
MVPRLLLRAWPRGPAVGPGAPSRPLSAGSGPGQYLQRSIVPTMHYQDSLPRLPIPKLEDTIRRYLSAQKPLLNDGQFRKTEQFCKSFENGIGKELHEQLVALDKQNKHTSYISGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAVHFEHSWGDGVAVLRFFNEVFKDSTQTPAVTPQSQPATTDSTVTVQKLNFELTDALKTGITAAKEKFDATMKTLTIDCVQFQRGGKEFLKKQKLSPDAVAQLAFQMAFLRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 5291 - protein, 391 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 5292 - protein, 391 aa, Homo sapiens; identical to SEQ ID NO: 5291

SEQ ID NO: 5293 - protein, 397 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGCLFQLPLRSAVTALSVS

SEQ ID NO: 5294 - protein, 255 aa, Homo sapiens
MYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 5295 - protein, 385 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSEMKFCRVAQAGLELLSSTVYPPWPPKVLRLEA

SEQ ID NO: 5296 - protein, 350 aa, Homo sapiens
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 5297 - protein, 199 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 5298 - protein, 121 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAEMRKLRPKDSVTCLASQLTWRF

SEQ ID NO: 5299 - protein, 199 aa, Homo sapiens; identical to SEQ ID NO: 5297

SEQ ID NO: 5300 - protein, 103 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGCWP

SEQ ID NO: 5301 - protein, 480 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 5302 - protein, 462 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 5303 - protein, 348 aa, Homo sapiens
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFREEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 5304 - protein, 300 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETENAHSWIFTLNSMATCMIGTAEFLPRRNIMSGCSTL

SEQ ID NO: 5305 - protein, 250 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSGGWNGTWMTKASFSLWLEIASLYILHIPDLPTPLPCIFMISAKCCQAVLNISVFKKESGICTGWQSYGHSGVLHVC

SEQ ID NO: 5306 - protein, 118 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKD

SEQ ID NO: 5307 - protein, 480 aa, Homo sapiens; identical to SEQ ID NO: 5301

SEQ ID NO: 5308 - protein, 62 aa, Homo sapiens
MSAEVIHQVEEALDTDEKEMLLFLCRDVAIDVVPPNVRDLLDILRERGKLSVGDLAELLYRV

SEQ ID NO: 5309 - protein, 64 aa, Homo sapiens
MSAEVIHQVEEALDTDEKEMLLFLCRDVAIDVVPPNVRDLLDILRERGKLSVGDLAELLYRVRR

SEQ ID NO: 5310 - protein, 129 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEK

SEQ ID NO: 5311 - protein, 384 aa, Homo sapiens
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 5312 - protein, 221 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRMITPYAHCPDLKILGNCSM

SEQ ID NO: 5313 - protein, 445 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 5314 - protein, 383 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 5315 - protein, 263 aa, Homo sapiens
MADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDNVSWRHPTMGSVFIGRLIEHMQEYACSCDVEEIFRKVRFSFEQPDGRAQMPTTERVTLTRCFYLFPGH

SEQ ID NO: 5316 - protein, 88 aa, Homo sapiens
MADKVLKEKRKLFIRSMGEDNVSWRHPTMGSVFIGRLIEHMQEYACSCDVEEIFRKVRFSFEQPDGRAQMPTTERVTLTRCFYLFPGH

SEQ ID NO: 5317 - protein, 383 aa, Homo sapiens; identical to SEQ ID NO: 5314

SEQ ID NO: 5318 - protein, 88 aa, Homo sapiens; identical to SEQ ID NO: 5316

SEQ ID NO: 5319 - protein, 404 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 5320 - protein, 263 aa, Homo sapiens; identical to SEQ ID NO: 5315

SEQ ID NO: 5321 - protein, 383 aa, Homo sapiens; identical to SEQ ID NO: 5314

SEQ ID NO: 5322 - protein, 311 aa, Homo sapiens
MADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 5323 - protein, 301 aa, Homo sapiens
MEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPGKSQS

SEQ ID NO: 5324 - protein, 110 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADLSNNGQVKPHTSCSHYLQ

SEQ ID NO: 5325 - protein, 88 aa, Homo sapiens; identical to SEQ ID NO: 5316

SEQ ID NO: 5326 - protein, 404 aa, Homo sapiens; identical to SEQ ID NO: 5319

SEQ ID NO: 5327 - protein, 263 aa, Homo sapiens; identical to SEQ ID NO: 5315

SEQ ID NO: 5328 - protein, 455 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 5329 - protein, 478 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 5330 - protein, 521 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 5331 - protein, 522 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 5332 - protein, 479 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 5333 - protein, 273 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNEGSCVQDESEPQRPLCHCQQPQLYLPEGQTRNP

SEQ ID NO: 5334 - protein, 242 aa, Homo sapiens
MSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 5335 - protein, 242 aa, Homo sapiens; identical to SEQ ID NO: 5334

SEQ ID NO: 5336 - protein, 452 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 5337 - protein, 108 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 5338 - protein, 313 aa, Homo sapiens
MHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGAGAIGSLGHLLLFTAATASLAL

SEQ ID NO: 5339 - protein, 330 aa, Homo sapiens
MLKLKTKFGSWQTLCKRSNVWQDKCFFKPFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 5340 - protein, 147 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFD

SEQ ID NO: 5341 - protein, 377 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 5342 - protein, 434 aa, Homo sapiens
MAEDSGKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 5343 - protein, 133 aa, Homo sapiens
MLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKHLSNKKERGPQTPGSHHMQYKV

SEQ ID NO: 5344 - protein, 447 aa, Homo sapiens
MAAVPRVEGVFIFLIEDSGKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 5345 - protein, 292 aa, Homo sapiens
MAALLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 5346 - protein, 376 aa, Homo sapiens
MAEDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 5347 - protein, 447 aa, Homo sapiens; identical to SEQ ID NO: 5344

SEQ ID NO: 5348 - protein, 292 aa, Homo sapiens; identical to SEQ ID NO: 5345

SEQ ID NO: 5349 - protein, 293 aa, Homo sapiens
MSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 5350 - protein, 204 aa, Homo sapiens
MSSASGLRRGHPAVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 5351 - protein, 303 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 5352 - protein, 303 aa, Homo sapiens; identical to SEQ ID NO: 5351

SEQ ID NO: 5353 - protein, 220 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSVTQAGVQRRDLGRLQPPPPRFKQYSCLSLLSSWDYRHAPPRLANFCIFRREGFRHVGQAGLKLLASSDPPTSGSQSAGITGVSLHTQPQIMKVSLRHCNTFICFA

SEQ ID NO: 5354 - protein, 303 aa, Homo sapiens; identical to SEQ ID NO: 5351

SEQ ID NO: 5355 - protein, 220 aa, Homo sapiens [sequence omitted]

SEQ ID NO: 5356 - protein, 336 aa, Homo sapiens
MDCVGWPPGRKWHLEKNTSCGGSSGICASYVTQMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 5357 - protein, 253 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENMESCSVTQAGVQRRDLGRLQPPPPRLAEGPSLMMASRPTRGPSMTQMLILDTRSQWKLTSSSPIPRFQAITRGGAQEEAPGLCKPSAPSWRSTEKTWKSCRSSPG

SEQ ID NO: 5358 - protein, 222 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFA

SEQ ID NO: 5359 - protein, 264 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 5360 - protein, 278 aa, Homo sapiens
MQRGLFSDGDTSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 5361 - protein, 395 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 5362 - protein, 496 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRFHFCRMSWAEANSQCQTQSVPFWRRVDHLLIRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 5363 - protein, 464 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 5364 - protein, 538 aa, Homo sapiens
MEGGRRARVVIESKRNFFLGAFPTPFPAEHVELGRLGDSETAMVPGKGGADYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 5365 - protein, 235 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNDFGQSLPNEKQTSGILSDHQQSQFCKSTGESAQTSQH

SEQ ID NO: 5366 - protein, 235 aa, Homo sapiens; identical to SEQ ID NO: 5365

SEQ ID NO: 5367 - protein, 278 aa, Homo sapiens [sequence omitted]

SEQ ID NO: 5368 - protein, 464 aa, Homo sapiens; identical to SEQ ID NO: 5363

SEQ ID NO: 5369 - protein, 220 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKDFGQSLPNEKQTSGILSDHQQSQFCKSTGESAQTSQH

SEQ ID NO: 5370 - protein, 198 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSN

SEQ ID NO: 5371 - protein, 116 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSE

SEQ ID NO: 5372 - protein, 479 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 5373 - protein, 124 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLL

SEQ ID NO: 5374 - protein, 209 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKDFGQSLPNEKQTSGILSDHQQSQFCK

SEQ ID NO: 5375 - protein, 416 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 5376 - protein, 266 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 5377 - protein, 200 aa, Homo sapiens
MEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGGFVSWRDPKSGSWYVETLDDIFEQWAHSEDLQSLLLRVANAVSVKGIYKQMPGCFNFLRKKLFFKTS

SEQ ID NO: 5378 - protein, 333 aa, Homo sapiens
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 5379 - protein, 254 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKASHLQFPGAVYGTDGCPVSVEKIVNIFNGTSCPSLGGKPKLFFI

SEQ ID NO: 5380 - protein, 266 aa, Homo sapiens
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFP

SEQ ID NO: 5381 - protein, 421 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVSAAFLCKGEGRLLRGSVSSWGWGFGVSRAGPNQG

SEQ ID NO: 5382 - protein, 906 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 5383 - protein, 803 aa, Homo sapiens
MKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 5384 - protein, 118 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSS

SEQ ID NO: 5385 - protein, 139 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLL

SEQ ID NO: 5386 - protein, 215 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQ

SEQ ID NO: 5387 - protein, 101 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQG

SEQ ID NO: 5388 - protein, 123 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGN

SEQ ID NO: 5389 - protein, 156 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKV

SEQ ID NO: 5390 - protein, 94 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAV

SEQ ID NO: 5391 - protein, 929 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGNCDTCGALQGLKGWPPPLCATHWVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 5392 - protein, 536 aa, Homo sapiens
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 5393 - protein, 891 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 5394 - protein, 781 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 5395 - protein, 781 aa, Homo sapiens; identical to SEQ ID NO: 5394

SEQ ID NO: 5396 - protein, 781 aa, Homo sapiens; identical to SEQ ID NO: 5394

SEQ ID NO: 5397 - protein, 781 aa, Homo sapiens; identical to SEQ ID NO: 5394

SEQ ID NO: 5398 - protein, 150 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELAT

SEQ ID NO: 5399 - protein, 13 aa, Homo sapiens
MATQADLMELDMA

SEQ ID NO: 5400 - protein, 100 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFP

SEQ ID NO: 5401 - protein, 108 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQ

SEQ ID NO: 5402 - protein, 774 aa, Homo sapiens
MELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 5403 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 5404 - protein, 339 aa, Homo sapiens; identical to SEQ ID NO: 5403

SEQ ID NO: 5405 - protein, 110 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWL

SEQ ID NO: 5406 - protein, 339 aa, Homo sapiens; identical to SEQ ID NO: 5403

SEQ ID NO: 5407 - protein, 339 aa, Homo sapiens; identical to SEQ ID NO: 5403

SEQ ID NO: 5408 - protein, 339 aa, Homo sapiens; identical to SEQ ID NO: 5403

SEQ ID NO: 5409 - protein, 339 aa, Homo sapiens; identical to SEQ ID NO: 5403

SEQ ID NO: 5410 - protein, 339 aa, Homo sapiens; identical to SEQ ID NO: 5403

SEQ ID NO: 5411 - protein, 339 aa, Homo sapiens; identical to SEQ ID NO: 5403

SEQ ID NO: 5412 - protein, 276 aa, Homo sapiens [sequence omitted]

SEQ ID NO: 5413 - protein, 245 aa, Homo sapiens
MPGAGPLSIPCRMSWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 5414 - protein, 412 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 5415 - protein, 333 aa, Homo sapiens [sequence omitted]

SEQ ID NO: 5416 - protein, 225 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATVSGAPCHHSSSAFGRWTL

SEQ ID NO: 5417 - protein, 333 aa, Homo sapiens [sequence omitted]

SEQ ID NO: 5418 - protein, 39 aa, Homo sapiens
MNPTLILAAFCLGIASATLTFDHSLEAQWTKWKAMHNRL

SEQ ID NO: 5419 - protein, 147 aa, Homo sapiens
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 5420 - protein, 147 aa, Homo sapiens; identical to SEQ ID NO: 5419

SEQ ID NO: 5421 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 5422 - protein, 162 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 5423 - protein, 112 aa, Homo sapiens
MGLETEKADVQLFMDDDSYSHHSGLEYADPEKFADSDQDRDPHRLNSHLKDFNAFCKDLPNGSAFSADNMEECDRCYHCSIVYERRTMLLFCQPATEPGLNTWTPGLEIGIL

SEQ ID NO: 5424 - protein, 113 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIW

SEQ ID NO: 5425 - protein, 345 aa, Homo sapiens
MQRLVAWDPACLPLPPPPPAFKSMEVANFYYEADCLAAAYGGKAAPAAPPAARPGPRPPAGELGSIGDHERAIDFSPYLEPLGAPQAPAPATATDTFEAAPPAPAPAPASSGQHHDFLSDLFSDDYGGKNCKKPAEYGYVSLGRLGAAKGALHPGCFAPLHPPPPPPPPPAELKAEPGFEPADCKRKEEAGAPGGGAGMAAGFPYALRAYLGYQAVPSGSSGSLSTSSSSSPPGTPSPADAKAPPTACYAGAAPAPSQVKSKAKKTVDKHSDEYKIRRERNNIAVRKSRDKAKMRNLETQHKVLELTAENERLQKKVEQLSRELSTLRNLFKQLPEPLLASSGHC

SEQ ID NO: 5426 - protein, 727 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 5427 - protein, 399 aa, Homo sapiens
MAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 5428 - protein, 375 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 5429 - protein, 375 aa, Homo sapiens; identical to SEQ ID NO: 5428

SEQ ID NO: 5430 - protein, 133 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQGKCSFP

SEQ ID NO: 5431 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 5432 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 5433 - protein, 662 aa, Homo sapiens
MESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRDAESSEMQRPPPDCDDTVTYSALHKRQVGDYENVIPDFPEDEGIHYSELIQFGVGERPQAQENVDYVILKH

SEQ ID NO: 5434 - protein, 670 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 5435 - protein, 675 aa, Homo sapiens
MSLWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 5436 - protein, 759 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 5437 - protein, 751 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKRCRVLRDAETSPGLR

SEQ ID NO: 5438 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 5439 - protein, 385 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 5440 - protein, 328 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLELEP

SEQ ID NO: 5441 - protein, 227 aa, Homo sapiens
MDFGPGRLFRFFSYCVVAHIQLAVFFFSVGILETRILLADGAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 5442 - protein, 355 aa, Homo sapiens
MSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 5443 - protein, 250 aa, Homo sapiens
MFLQMYPTKKLQHLVPLEVPACTLCLNMAMRPQQTSQAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 5444 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 5445 - protein, 127 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 5446 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 5447 - protein, 240 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5448 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 5449 - protein, 203 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 5450 - protein, 261 aa, Homo sapiens
GRSPLRTRDRVLTNWEDGLTVAYGAVKLIQSLSLQPVGWQQNWGLSSPPTMLLPSRAQSPTELPLAPLAEPNTGCSSLLSWHSTRGELHLWALGLGQMGGSKCGSPLSPLAPTLEALRRPWCGQQGAGGTRGISTDPPSGKGGRAWGRDPLPREGLLRGTAAPAAGGDLTPCLSRPPTPSRNPRRSIFPTIFLAPTLLLQCRRLYMDANRSPRRMAKRVASQCRRDSEAAPTQECGHVGKQAVGQRAWCCCCCGVRVRGWH

SEQ ID NO: 5451 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 5452 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5453 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 5454 - protein, 340 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5455 - protein, 396 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTRRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5456 - protein, 699 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5457 - protein, 80 aa, Homo sapiens
MDKFWWHAAWGLCLVPLSLAQIDLNITCRFAGVFHVEKNGRYSISRTEAADLCKAFNSTLPTMAQMEKALSIGFETCSST

SEQ ID NO: 5458 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5459 - protein, 714 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTADVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTRNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5460 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5461 - protein, 429 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5462 - protein, 674 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5463 - protein, 699 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 5464 - protein, 78 aa, Homo sapiens
MDKFWWHAAWGLCLVPLSLAQIDLNITCRFAGVFHVEKNGRYSISRTEAADLCKAFNSTLPTMAQMEKALSIGFETCR

SEQ ID NO: 5465 - protein, 294 aa, Homo sapiens
  MOD_RES (1)..(1): Any amino acid
XDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRS

SEQ ID NO: 5466 - protein, 305 aa, Homo sapiens
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRNN

SEQ ID NO: 5467 - protein, 323 aa, Homo sapiens
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 5468 - protein, 495 aa, Homo sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 5469 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 5470 - protein, 208 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGLFGFWNWGLKVKCFLRHLIWTAHCFIPLTQLVFMQALQSWRNHHCSHFTDEENRGVNR

SEQ ID NO: 5471 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 5472 - protein, 188 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 5473 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 5474 - protein, 162 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKGFAPRCRERRRNERLRRESVRPV

SEQ ID NO: 5475 - protein, 256 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTSFAPRCRERRRNERLRRESVRPV

SEQ ID NO: 5476 - protein, 288 aa, Homo sapiens; identical to SEQ ID NO: 5473

SEQ ID NO: 5477 - protein, 267 aa, Homo sapiens
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 5478 - protein, 242 aa, Homo sapiens
MGSACIKVTKYFLFLFNLIFFILGAVILGFGVWILADKSSFISVLQTSSSSLRMGAYVFIGVGAVTMLMGFLGCIGAVNEVRCLLGLLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 5479 - protein, 68 aa, Homo sapiens
MGSACIKVTKYFLFLFNLIFFILGAVILGFGVWILADKSSFISVLQTSSSSLRMGAYVFIGVGAVTML

SEQ ID NO: 5480 - protein, 38 aa, Homo sapiens
MGSACIKVTKYFLFLFNLIFFILGAVILGFGVWILADK

SEQ ID NO: 5481 - protein, 105 aa, Homo sapiens
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGAL

SEQ ID NO: 5482 - protein, 108 aa, Homo sapiens
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYF

SEQ ID NO: 5483 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 5484 - protein, 198 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAGNRRRVCKCPRPVVKSGDKPSLSARYV

SEQ ID NO: 5485 - protein, 235 aa, Homo sapiens; identical to SEQ ID NO: 5483

SEQ ID NO: 5486 - protein, 198 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPVHTRGLDFACDIYIWAPLAGTCGVLLLSLVITLYCNHRNRRRVCKCPRPVVKSGDKPSLSARYV

SEQ ID NO: 5487 - protein, 220 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 5488 - protein, 198 aa, Homo sapiens; identical to SEQ ID NO: 5484

SEQ ID NO: 5489 - protein, 276 aa, Homo sapiens
MRNQAPGRPKGATFPPRRPTGSRAPPLAPELRAKQRPGERVMALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 5490 - protein, 79 aa, Homo sapiens [sequence omitted]

SEQ ID NO: 5491 - protein, 67 aa, Homo sapiens
MSHKQIYYSDKYDDEEFEYRHVMLPKDIAKLVPKTHLMSESEWRNLGVQQSQGWVHYMIHEPGQCTG

SEQ ID NO: 5492 - protein, 63 aa, Homo sapiens
MRTRHVMLPKDIAKLVPKTHLMSESEWRNLGVQQSQGWVHYMIHEPEPHILLFRRPLPKKPKK

SEQ ID NO: 5493 - protein, 79 aa, Homo sapiens
MAHKQIYYSDKYFDEHYEYRHVMLPRELSKQVPKTHLMSEEEWRRLGVQQSLGWVHYMIHEPEPHILLFRRPLPKDQQK

SEQ ID NO: 5494 - protein, 510 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 5495 - protein, 587 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 5496 - protein, 601 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQVFLPPRPPKVLGLQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 5497 - protein, 327 aa, Homo sapiens
MNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 5498 - protein, 497 aa, Homo sapiens
MMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 5499 - protein, 426 aa, Homo sapiens
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPEDTGIS

SEQ ID NO: 5500 - protein, 373 aa, Homo sapiens
GDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 5501 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 5502 - protein, 127 aa, Homo sapiens
MLYVYDPPTTIPPPTTTTTTTTTTTTTILTIITDTTATTEPAVHDSRAGEEGSIRAVDHAVIGGVVAVVVFAMLCLLIILGRYFARHKGTYFTHEAKGADDAADADTAIINAEGGQNNSEEKKEYFI

SEQ ID NO: 5503 - protein, 414 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 5504 - protein, 388 aa, Homo sapiens
MGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGSYLTHEASGLDEQGEAREAFLNGSDGHKRKEEFFI

SEQ ID NO: 5505 - protein, 219 aa, Homo sapiens
MEAARDYAGALIRPLTFMGSQTKRVLFTPLMHPARPFRVSNHDRSSRRGVMASSLQELISKTLDALVIATGLVTLVLEEDGTVVDTEEFFQTLGDNTHFMILEKGQKWMPGSQHVPTCSPPKRSGIARVTFDLYRLNPKDFIGCLNVKATMYEMYSVSYDIRCTGLKGLLRSLLRFLSYSAQVTGQFLIYLGTYMLRVLDDKEERPSLRSQAKGRFTCG

SEQ ID NO: 5506 - protein, 219 aa, Homo sapiens
MEYLSALNPSDLLRSVSNISSEFGRRVWTSAPPPQRPFRVCDHKRTIRKGLTAATRQELLAKALETLLLNGVLTLVLEEDGTAVDSEDFFQLLEDDTCLMVLQSGQSWSPTRSGVLSYGLGRERPKHSKDIARFTFDVYKQNPRDLFGSLNVKATFYGLYSMSCDFQGLGPKKVLRELLRWTSTLLQGLGHMLLGISSTLRHAVEGAEQWQQKGRLHSY

SEQ ID NO: 5507 - protein, 219 aa, Homo sapiens; identical to SEQ ID NO: 5506

SEQ ID NO: 5508 - protein, 219 aa, Homo sapiens; identical to SEQ ID NO: 5506

SEQ ID NO: 5509 - protein, 219 aa, Homo sapiens; identical to SEQ ID NO: 5506

SEQ ID NO: 5510 - protein, 619 aa, Homo sapiens
MNLERLRKRVRQYLDQQQYQSALFWADKVASLSREPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 5511 - protein, 475 aa, Homo sapiens
MEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 5512 - protein, 620 aa, Homo sapiens
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 5513 - protein, 620 aa, Homo sapiens; identical to SEQ ID NO: 5512

SEQ ID NO: 5514 - protein, 526 aa, Homo sapiens
MEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 5515 - protein, 526 aa, Homo sapiens; identical to SEQ ID NO: 5514

SEQ ID NO: 5516 - protein, 475 aa, Homo sapiens; identical to SEQ ID NO: 5511

SEQ ID NO: 5517 - protein, 499 aa, Homo sapiens
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 5518 - protein, 499 aa, Homo sapiens; identical to SEQ ID NO: 5517

SEQ ID NO: 5519 - protein, 475 aa, Homo sapiens
MAQFAFESDLHSLLQLDAPIPNAPPARWQRKAKEAAGPAPSPMRAANRSHSAGRTPGRTPGKSSSKVQTTPSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 5520 - protein, 473 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 5521 - protein, 400 aa, Homo sapiens
MSTELFSSTREEGSSGSGPSFRSNQRKMLNLLLERDTSFTVCPDVPRTPVGKFLGDSANLSILSGSPGFFRTSGSAFSWDDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 5522 - protein, 443 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 5523 - protein, 430 aa, Homo sapiens
MSTELFSSTREEGSSGSGPSFRSNQRKMLNLLLERDTSFTVCPDVPRTPVGKFLGDSANLSILSGSPGFFRTSGSAFSWDAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 5524 - protein, 400 aa, Homo sapiens; identical to SEQ ID NO: 5521

SEQ ID NO: 5525 - protein, 249 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQ

SEQ ID NO: 5526 - protein, 473 aa, Homo sapiens; identical to SEQ ID NO: 5520

SEQ ID NO: 5527 - protein, 490 aa, Homo sapiens
MSEEARFCFSPGENSKTMSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 5528 - protein, 236 aa, Homo sapiens
MARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 5529 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 5530 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 5531 - protein, 191 aa, Homo sapiens; identical to SEQ ID NO: 5530

SEQ ID NO: 5532 - protein, 136 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKP

SEQ ID NO: 5533 - protein, 233 aa, Homo sapiens
MSPDILHNKQISIGICTDYLDFSWVNYIHFKQLKNQWKVRRGDTGFARSAGRQNSSRQDSNEWWSQFGEVCPTSWNEVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 5534 - protein, 560 aa, Homo sapiens
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQNKILSSVRKSQEITTNSEQRCPLKKESACVRLFKQEGTCYQQAKLVLNTAVPDRLPAREREMDVIRNFLREHICGKKAGSLYLSGAPGTGKTACLSRILQDLKKELKGFKTIMLNCMSLRTAQAVFPAIAQEICQEEVSRPAGKDMMRKLEKHMTAEKGPMIVLVLDEMDQLDSKGQDVLYTLFEWPWLSNSHLVLIGIANTLDLTDRILPRLQAREKCKPQLLNFPPYTRNQIVTILQDRLNQVSRDQVLDNAAVQFCARKVSAVSGDVRKALDVCRRAIEIVESDVKSQTILKPLSECKSPSEPLIPKRVGLIHISQVISEVDGNRMTLSQEGAQDSFPLQQKILVCSLMLLIRQLKIKEVTLGKLYEAYSKVCRKQQVAAVDQSECLSLSGLLEARGILGLKRNKETRLTKVFFKIEEKEIEHALKDKALIGNILATGLP

SEQ ID NO: 5535 - protein, 531 aa, Homo sapiens
MADVLSVLRQYNIQKKEIVVKGDEVIFGEFSWPKNVKTNYVVWGTGKEGQPREYYTLDSILFLLNNVHLSHPVYVRRAATENIPVVRRPDRKDLLGYLNGEASTSASIDRSAPLEIGLQRSTQVKRAADEVLAEAKKPRIEDEECVRLDKERLAARLEGHKEGIVQTEQIRSLSEAMSVEKIAAIKAKIMAKKRSTIKTDLDDDITALKQRSFVDAEVDVTRDIVSRERVWRTRTTILQSTGKNFSKNIFAILQSVKAREEGRAPEQRPAPNAAPVDPTLRTKQPIPAAYNRYDQERFKGKEETEGFKIDTMGTYHGMTLKSVTEGASARKTQTPAAQPVPRPVSQARPPPNQKKGSRTPIIIIPAATTSLITMLNAKDLLQDLKFVPSDEKKKQGCQRENETLIQRRKDQMQPGGTAISVTVPYRVVDQPLKLMPQDWDRVVAVFVQGPAWQFKGWPWLLPDGSPVDIFAKIKAFHLKYDEVRLDPNVQKWDVTVLELSYHKRHLDRPVFLRFWETLDRYMVKHKSHLRF

SEQ ID NO: 5536 - protein, 316 aa, Homo sapiens
MADVLSVLRQYNIQKKEIVVKGDEVIFGEFSWPKNVKTNYVVWGTGKEGQPREYYTLDSILFLLNNVHLSHPVYVRRAATENIPVVRRPDRKDLLGYLNGEASTSASIDRSAPLEIGLQRSTQVKRAADEVLAEAKKPRIEDEECVRLDKERLAARLEGHKEGIVQTEQIRSLSEAMSVEKIAAIKAKIMAKKRSTIKTDLDDDITALKQRSFVDAEVDVTRDIVSRERVWRTRTTILQSTGKNFSKNIFAILQSVKAREEGRAPEQRPAPNAAPVDPTLRTKQPIPAAYNRYDQERISNTHYHNSCSYHLFNNHA

SEQ ID NO: 5537 - protein, 438 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5538 - protein, 167 aa, Homo sapiens
MGGCAGSRRRFSDSEGEETVPEPRLPLLDHQGAHWKNAVGFWLLGLCNNFSYVVMLSAAHDILSHKRTSGNQSHPPGSRQWDLCCWKLRPGCLFSFCGDQPVCYFLLLTSPEAQDPGGEEEAESAARQPLIRTEAPESKPGSSSSLSLRERWTVFKGLLWYIVPLVV

SEQ ID NO: 5539 - protein, 421 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKVRMMAGFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5540 - protein, 390 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPSYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5541 - protein, 253 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGSSSSLSLRERWTVFKGLLWYIVPLVVVYFAEYFINQGLFELLFFWNTSLSHAQQYRWYQMLYQAGVFASRSSLRCCRIRFTWALALLQMESRSVAQAGM

SEQ ID NO: 5542 - protein, 339 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5543 - protein, 384 aa, Homo sapiens
MLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5544 - protein, 438 aa, Homo sapiens; identical to SEQ ID NO: 5537

SEQ ID NO: 5545 - protein, 438 aa, Homo sapiens; identical to SEQ ID NO: 5537

SEQ ID NO: 5546 - protein, 338 aa, Homo sapiens
MWTQAQRRSPTTAHHDLTATLSLRLPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5547 - protein, 360 aa, Homo sapiens
MLSAAHDILSHKRTSGNQSHAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 5548 - protein, 432 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQVTISTTDRRNNKLIFKVNLLEMDDKILVDFRLSKGDGLEFKRHFLKIKGKLIDIVSSQKIWLPAT

SEQ ID NO: 5549 - protein, 476 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 5550 - protein, 476 aa, Homo sapiens; identical to SEQ ID NO: 5549

SEQ ID NO: 5551 - protein, 476 aa, Homo sapiens; identical to SEQ ID NO: 5549

SEQ ID NO: 5552 - protein, 133 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKP

SEQ ID NO: 5553 - protein, 170 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGT

SEQ ID NO: 5554 - protein, 204 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAG

SEQ ID NO: 5555 - protein, 42 aa, Homo sapiens
MAVPFVEDWDLVQTLGEGAYGEVQLAVNRVTEEAVAVKIVDM

SEQ ID NO: 5556 - protein, 476 aa, Homo sapiens; identical to SEQ ID NO: 5549

SEQ ID NO: 5557 - protein, 127 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGIT

SEQ ID NO: 5558 - protein, 442 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQGDGLEFKRHFLKIKGKLIDIVSSQKIWLPAT

SEQ ID NO: 5559 - protein, 543 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 5560 - protein, 514 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 5561 - protein, 226 aa, Homo sapiens
MSRESDVEAQQSHGSSACSQPHGSVTQSQGSSSQSQGISSSSTSTMPNSSQSSHSSSGTLSSLETVSTQELYSIPPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 5562 - protein, 163 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLGDEDMKRKFQDLLSEENESTALPQVLAQPSTSRKRPREGEAEGAETTKRPAVCAAVL

SEQ ID NO: 5563 - protein, 289 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHDGRGRAV

SEQ ID NO: 5564 - protein, 452 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 5565 - protein, 586 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 5566 - protein, 514 aa, Homo sapiens; identical to SEQ ID NO: 5560

SEQ ID NO: 5567 - protein, 452 aa, Homo sapiens; identical to SEQ ID NO: 5564

SEQ ID NO: 5568 - protein, 543 aa, Homo sapiens; identical to SEQ ID NO: 5559

SEQ ID NO: 5569 - protein, 543 aa, Homo sapiens; identical to SEQ ID NO: 5559

SEQ ID NO: 5570 - protein, 322 aa, Homo sapiens
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 5571 - protein, 207 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKEKILKIYSLS

SEQ ID NO: 5572 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 5573 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 5574 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 5575 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 5576 - protein, 91 aa, Homo sapiens; identical to SEQ ID NO: 5575

SEQ ID NO: 5577 - protein, 99 aa, Homo sapiens
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 5578 - protein, 109 aa, Homo sapiens
MWKPMPSPSNMKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 5579 - protein, 91 aa, Homo sapiens
MWKPMPSPSNMKASAALLCLLLTAAAFSPQGLAQPERPRTHPQWTFLLVVSLQLGLILQLPAATDLSIRKSLSRGWRATEGPPVATVPGKL

SEQ ID NO: 5580 - protein, 57 aa, Homo sapiens
MWKPMPSPSNMKASAALLCLLLTAAAFSPQGLAQPASRPNWTRRSVLTPHRSGSRTL

SEQ ID NO: 5581 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 5582 - protein, 89 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 5583 - protein, 119 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKGRREEKVGKKEKIGKKKRQKKRKAAQKRKN

SEQ ID NO: 5584 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 5585 - protein, 140 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNNLISAAPAGKRVIAGARALHPSPPRACPTARALCEIRLWPPPEWSWPSPGDV

SEQ ID NO: 5586 - protein, 90 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNNC

SEQ ID NO: 5587 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 5588 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 5589 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 5590 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 5591 - protein, 138 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLA

SEQ ID NO: 5592 - protein, 15 aa, Homo sapiens
MEDFNMESDSFEDFW

SEQ ID NO: 5593 - protein, 172 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGL

SEQ ID NO: 5594 - protein, 15 aa, Homo sapiens
MEDFNMESDSFEDFW

SEQ ID NO: 5595 - protein, 201 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMG

SEQ ID NO: 5596 - protein, 136 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILL

SEQ ID NO: 5597 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 5598 - protein, 356 aa, Homo sapiens
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 5599 - protein, 222 aa, Homo sapiens
MPWQTGTLGTSYARQSMSSTQSTSTAVSSSWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 5600 - protein, 943 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 5601 - protein, 140 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDQGVEKRENTFISHLISY

SEQ ID NO: 5602 - protein, 410 aa, Homo sapiens
MNDEDYSTIYDTIQNERTYEVPDQPEENESPHYDDVHEYLRPENDLYATQLNTHEYDFVSVYTIKGEETSLASVQSEDRGYLLPDEIYSELQEAHPGEPQEDRGISMEGLYSSTQDQQLCAAELQENGSVMKEDLPSPSSFTIQHSKAFSTTKYSCYSDAEGLEEKEGAHMNPEIYLFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 5603 - protein, 251 aa, Homo sapiens
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 5604 - protein, 205 aa, Homo sapiens
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKEQVPLKGMI

SEQ ID NO: 5605 - protein, 1940 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRGVCGRPRPPPMGRSTRAVGPAHLPSLPPDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 5606 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 5607 - protein, 1886 aa, Homo sapiens [sequence omitted]

SEQ ID NO: 5608 - protein, 1905 aa, Homo sapiens
MASGLGSPSPCSAGSEEEDMDALLNNSLPPPHPENEEDPEEDLSETETPKLKKKKKPKKPRDPKIPKSKRQKKELGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 5609 - protein, 1937 aa, Homo sapiens
MASGLGSPSPCSAGSEEEDMDALLNNSLPPPHPEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRGVCGRPRPPPMGRSTRAVGPAHLPSLPPDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 5610 - protein, 354 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKK

SEQ ID NO: 5611 - protein, 354 aa, Homo sapiens; identical to SEQ ID NO: 5610

SEQ ID NO: 5612 - protein, 853 aa, Homo sapiens
MFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQPYAKRARQEFPWEEEYRSALHTIAGALEATESLLQKGPAPAWLSMEMEALQERMDKLKRYIHTLG

SEQ ID NO: 5613 - protein, 853 aa, Homo sapiens; identical to SEQ ID NO: 5612

SEQ ID NO: 5614 - protein, 330 aa, Homo sapiens
MMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLGYLYSKPFSTVLSSVLVNSLYLFIYRD

SEQ ID NO: 5615 - protein, 348 aa, Homo sapiens
MSQEGAVPASAVPLEELSSWPEELCRRELPSVLPRLLSLSQHSDSWIEHIQILKIIVEMFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHRWSFALAV

SEQ ID NO: 5616 - protein, 699 aa, Homo sapiens
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 5617 - protein, 652 aa, Homo sapiens
MISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 5618 - protein, 383 aa, Homo sapiens
MISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRADLLQEGQHKQLSMFQR

SEQ ID NO: 5619 - protein, 383 aa, Homo sapiens; identical to SEQ ID NO: 5618

SEQ ID NO: 5620 - protein, 242 aa, Homo sapiens
  MOD_RES (1)..(1): Any amino acid
XWSGSFPLENTELANVGANQVTVRKGEKDHTTHCHASDHANQLSIHIPGWSYRAGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 5621 - protein, 662 aa, Homo sapiens
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEV

SEQ ID NO: 5622 - protein, 602 aa, Homo sapiens
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 5623 - protein, 796 aa, Homo sapiens
MQHSGIPTKTHPQGYAARYTETAVHRTFQIKTFSTELKNHVMVMDFVKSNWFPSQRRAKVCIIHMCQGLKTAEQTASRYEIHSRLFSSPKDHSAWERNESLSNAGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 5624 - protein, 261 aa, Homo sapiens
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 5625 - protein, 261 aa, Homo sapiens
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 5626 - protein, 250 aa, Homo sapiens
MSTTTCQVVAFLLSILGLAGCIAATGMDMWSTQDLYDNPVTSVFQYEGLWRSCVRQSSGFTECRPYFTILGLPAMLQAVRALMIVAIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 5627 - protein, 999 aa, Homo sapiens
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 5628 - protein, 556 aa, Homo sapiens
MKPPTKQQDGELVGYRISHVWQSAGISKELLEEVGQNGSRARISVQVHNATCTVRIAAVTRGGVGPFSDPVKIFIPAHGESYTHAQIARNLHKVRPAYISLTICSSLLQASVSHIFQTMTGLLVSTRLGRLCPLFNSGAWQRRSCAHHLWLLLWILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGTSEKCRWVAKRALLICSVPKEKISGVDKNCLQIHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPTAWMNCDQVGMCRGVEPTDTPAQEPFLMWEIVYECTLAGEPIPDRPTFSVLRLQLEKLLESLPDVRNQADVIYVNTQLLESSEGLALHPCSTGLEHRP

SEQ ID NO: 5629 - protein, 823 aa, Homo sapiens
MKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 5630 - protein, 999 aa, Homo sapiens; identical to SEQ ID NO: 5627

SEQ ID NO: 5631 - protein, 166 aa, Homo sapiens
MASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 5632 - protein, 166 aa, Homo sapiens; identical to SEQ ID NO: 5631

SEQ ID NO: 5633 - protein, 91 aa, Homo sapiens
MASGVAVSDGVIKVFNDMKVRKSSTPEEVKKRKKAVLFCLSEDKKNIILEEGKEILVGDVGQTVDDPYATFVKMLPDKDCRYALYDATYET

SEQ ID NO: 5634 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 5635 - protein, 1367 aa, Homo sapiens
MLSFVDTRTLLLLAVTLCLATCQCTLGGQTLSKFPPYLHIERSEQGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 5636 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 5637 - protein, 1163 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGLFGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 5638 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPSSDESFKNKLKNKGLNYYTVNSMQGDVGQPGPNGIPSDTLHPIIAPTGVTFHPDQYKGPVGWRGRPWVAGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 5639 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 5640 - protein, 105 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDV

SEQ ID NO: 5641 - protein, 1498 aa, Homo sapiens
MSARTAPRPQVLLLPLLLVLLAAAPAASKGCVCKDKGQCFCDGAKGEKGEKGFPGPPGSPGQKGFTGPEGLPGPQGPKSFRAIPSYSGGKSLQGISGLPGFSGSPGLPGTPGNTGPYGLVGVPGCSGSKGEQGFPGLPGTLGYPGIPGIHNLKIFKGAPAKEEDIELDAKGDPGLPGAPGPQGLPGPPGFPGPVGPPGPPGFFGFPGAMGPRGPKSFVLSSRISTKGEKGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKEEKRDVAIVSFSSKTEYYDTYQEKGDEGTPGPPGPRGARGPQGKNKFRCIPGSQGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLDALFVKVLRSP

SEQ ID NO: 5642 - protein, 1637 aa, Homo sapiens
MSARTAPRPQVLLLPLLLVLLAAAPAASKGCVCKDKGQCFCDGAKGEKGEKGFPGPPGSPGQKGFTGPEGLPGPQGPKSFRAIPSYSGGKSLQGISGLPGFSGSPGLPGTPGNTGPYGLVGVPGCSGSKGEQGFPGLPGTLGYPGIPGIHNLKIFKGAPAKEEDIELDAKGDPGLPGAPGPQGLPGPPGFPGPVGPPGPPGFFGFPGAMGPRGPKSFVLSSRISTKGEKGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKEEKRDVAIVSFSSKTEYYDTYQEKGDEGTPGPPGPRGARGPQGKNKFRCIPGSQGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMKAYSINCESWGIRKNNKSLSGVHEEKTLKLKKTAELLFFILKNKVMTEHAVI

SEQ ID NO: 5643 - protein, 1494 aa, Homo sapiens
MSARTAPRPQVLLLPLLLVLLAAAPAASKGCVCKDKGQCFCDGAKGEKGEKGFPGPPGSPGQKGFTGPEGLPGPQGPKSFRAIPSYSGGKSLQGISGLPGFSGSPGLPGTPGNTGPYGLVGVPGCSGSKGEQGFPGLPGTLGYPGIPGIHNLKIFKGAPAKEEDIELDAKGDPGLPGAPGPQGLPGPPGFPGPVGPPGPPGFFGFPGAMGPRGPKSFVLSSRISTKGEKGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKEEKRDVAIVSFSSKTEYYDTYQEKGDEGTPGPPGPRGARGPQGKNKFRCIPGSQGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLESLFHQL

SEQ ID NO: 5644 - protein, 1424 aa, Homo sapiens
MSARTAPRPQVLLLPLLLVLLAAAPAASKGCVCKDKGQCFCDGAKGEKGEKGFPGPPGSPGQKGFTGPEGLPGPQGPKSFRAIPSYSGGKSLQGISGLPGFSGSPGLPGTPGNTGPYGLVGVPGCSGSKGEQGFPGLPGTLGYPGIPGIHNLKIFKGAPAKEEDIELDAKGDPGLPGAPGPQGLPGPPGFPGPVGPPGPPGFFGFPGAMGPRGPKSFVLSSRISTKGEKGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKEEKRDVAIVSFSSKTEYYDTYQEKGDEGTPGPPGPRGARGPQGKNKFRCIPGSQGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPESLFHQL

SEQ ID NO: 5645 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 5646 - protein, 1499 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 5647 - protein, 1139 aa, Homo sapiens
LPGRRHRLGPPGSQGPRGERGPKGRPGPRGPQGIDGEPGVPGQPGAPGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 5648 - protein, 1767 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 5649 - protein, 1818 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 5650 - protein, 1026 aa, Homo sapiens
MVSEVSRDLKVKREKLVKLAQEGKMALKDPKVEQAQLETQVLQVKQEKRENLEFQDYQDIQEDKVQRISDVIGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 5651 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 5652 - protein, 1690 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 5653 - protein, 1519 aa, Homo sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 5654 - protein, 1754 aa, Homo sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 5655 - protein, 1339 aa, Homo sapiens
MAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 5656 - protein, 1339 aa, Homo sapiens
MAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPVSPHVPPSPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLQGAGAPGVQGSKGAPGPAGARGESGLAGAPGPAGPPGPPGPPGPPGPGLPAGFDDMEGSGGPFWSTARSADGPQEPPALHGIGGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 5657 - protein, 1754 aa, Homo sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPVSPHVPPSPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLQGAGAPGVQGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 5658 - protein, 540 aa, Homo sapiens
MGPGERAGGGGDAGKGNAAGGGGGGRSATTAGSRAVSALCLLLSVGSAAACLLLGVQAAALQGRVAALEEERELLRRAGPPGALDAWAEPHLERLLREKLDGLAKIRTAREAPSECVCPPGPPGRRGKPGRRGDPGPPGQSGRDGYPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGAPGLKGEQGDTVVIDYDGRILDALKGPPGPQGPPGPPGIPGAKGELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 5659 - protein, 309 aa, Homo sapiens
MESRSGIQAGVRCRDLGSLQPPPLALKQFSSLSLPSSWDYRRLPPRCGFLFEVSETTNPPAGTNSRHTLTVKLDGLAKIRTAREAPSECVCPPGPPGRRGKPGRRGDPGPPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGDVRDPGLGSVSSCSQRLASSSKKNGSEPPPGCAGCPRPQGRAGRHSGDRL

SEQ ID NO: 5660 - protein, 554 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 5661 - protein, 438 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGHERQSEGSFSPQLQESVFHLLVPSVILVLLAVGGLLFYRWRRRSHQEPQRADSPLEQPEGSPLTQDDRQVELPV

SEQ ID NO: 5662 - protein, 119 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRL

SEQ ID NO: 5663 - protein, 438 aa, Homo sapiens; identical to SEQ ID NO: 5661

SEQ ID NO: 5664 - protein, 554 aa, Homo sapiens; identical to SEQ ID NO: 5660

SEQ ID NO: 5665 - protein, 256 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSFSPQLQESVFHLLVPSVILVLLAVGGLLFYRWRRRSHQEPQRADSPLEQPEGSPLTQDDRQVELPV

SEQ ID NO: 5666 - protein, 275 aa, Homo sapiens
GSPGMAGALCAGHIAGLYGDRGLVPSTRREERGGRKTWQTGAARPQGGARGAGGPWHPDRHPRPKETRGNLGPLETPARWATQGPAAPSEPIPGIKGTKGSPGNIKDQPRPAFSAIRRNPNGGQRGHSTRSSPTRKNRTRTTPADSSALYPATTTSPSRCCPSGKSACPSSPPQGARSDAPWASVTPPTRGSSRWCQGAWCFSCSRVTRSGLKKTPKRVTFTRALRPTASSAASSSSHLPEPGKDPLPHPPLWLPCSACKMGALLLQLLKGGGWL

SEQ ID NO: 5667 - protein, 245 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 5668 - protein, 245 aa, Homo sapiens; identical to SEQ ID NO: 5667

SEQ ID NO: 5669 - protein, 221 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDP

SEQ ID NO: 5670 - protein, 349 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCHFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 5671 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLVVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 5672 - protein, 550 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 5673 - protein, 513 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRYGLFPANYVELRQ

SEQ ID NO: 5674 - protein, 634 aa, Homo sapiens
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGLRSALWRVGRKDCPRRGASSRVSLLGRRGLGLMEVNPELSHPEHRSCHVRWEICLCHTVTARRIRKLISFLRSREAGPVPSCSQVGGVSFQKVTWKCLGTWVPECP

SEQ ID NO: 5675 - protein, 314 aa, Homo sapiens
MDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGITAVALYDYQAAGDDEISFDPDDIITNIEMIDDGWWRGVCKGRFRELAFSCVRVALVPIKCSRDLPGQARGLRSALWRVGRKDCPRRGASSRVSLLGRRGLGLMEVNPELSHPEHRSCHVRWEICLCHTVTARRIR

SEQ ID NO: 5676 - protein, 586 aa, Homo sapiens
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVKKNSSPPLSLYGQLLWREFFYTAATNNPRFDKMEGNPICVQIPWDKNPEALAKWAEGRTGFPWIDAIMTQLRQEGWIHHLARHAVACFLTRGDLWISWEEGMKVFEELLLDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 5677 - protein, 193 aa, Homo sapiens
MLEVGCGCLVVPFFNFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 5678 - protein, 440 aa, Homo sapiens
MGSSHLLNKGLPLGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 5679 - protein, 429 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 5680 - protein, 145 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRV

SEQ ID NO: 5681 - protein, 171 aa, Homo sapiens
MSGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGL

SEQ ID NO: 5682 - protein, 985 aa, Homo sapiens
MPVPSRHINIGRSQSWDAAGWYEGPWENAESLRPLGRRSSLTYGTAEGTWFEPNHRPQDAALPVAAEPYLYREAVYNSVAARKGSTPDFTFYDSRQAVMSGRSPLLPREYYSDPSGAARVPKEPPLYRDPGVSRPVPSYGVLGSRTSWDPMQGRSPALQDAGHLYRDPGGKMIPQGRQTQSRAASPGRYGREQPDTRYGAEVPAYPLSQVFSDISERPIDPAPARQVAPTCLVVDPSSAAAPEGSTGVAPGALNRGYGPARESIPSKMAYETYEADLSTFQGPGGKRTVLPEFLAFLRAEGLAEATLGALLQQGFDSPAVLATLEDADIKSVAPNLGQARVLSRLANSCRTEMQLRRQDRGGPLPRARSSSFSHRSELLHGDLASLGAAAPLQTASPRAGDPARRPSSAPSQHLLETAATYSAPGVGTHAPHFPSNSGYSSPTPCALTARLSPTYPLQAGVALTNPGPSNPLHPGPRTAYSTAYTVPMELLKRERNVAASPLPSPHGSPQVLRKPGAPLGPSTLPPASQSLHTPHSPYQKVARRTGAPIIVSTMLAPEPSIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ
